US011254949B2

(12) United States Patent
Kock et al.

(10) Patent No.: US 11,254,949 B2
(45) Date of Patent: Feb. 22, 2022

(54) **METHOD FOR MODIFYING THE RESISTANCE PROFILE OF *SPINACIA OLERACEA* TO DOWNY MILDEW**

(71) Applicant: RIJK ZWAAN ZAADTEELT EN ZAADHANDEL B.V., De Lier (NL)

(72) Inventors: Vincent Laurens Adrianus Kock, De Lier (NL); Johannes Geert Jan Feitsma, De Lier (NL); Raoul Jacobus Johannes Maria Frijters, De Lier (NL)

(73) Assignee: RIJK ZWAAN ZAADTEELT EN ZAADHANDEL B.V., De Lier (NL)

( * ) Notice: Subject to any disclaimer, the term of this patent is extended or adjusted under 35 U.S.C. 154(b) by 110 days.

(21) Appl. No.: 16/361,564

(22) Filed: Mar. 22, 2019

(65) Prior Publication Data

US 2019/0241905 A1   Aug. 8, 2019

Related U.S. Application Data

(63) Continuation-in-part of application No. PCT/EP2017/074863, filed on Sep. 29, 2017.

(30) Foreign Application Priority Data

Sep. 30, 2016   (WO) ................. PCT/EP2016/001621

(51) Int. Cl.
*C12Q 1/6895* (2018.01)
*A01H 5/12* (2018.01)
*A01H 6/02* (2018.01)
*C12N 15/82* (2006.01)

(52) U.S. Cl.
CPC ........... *C12N 15/8282* (2013.01); *A01H 5/12* (2013.01); *A01H 6/028* (2018.05); *C12Q 1/6895* (2013.01); *C12Q 2600/13* (2013.01); *C12Q 2600/156* (2013.01)

(58) Field of Classification Search
None
See application file for complete search history.

(56) References Cited

U.S. PATENT DOCUMENTS

| 9,265,275 | B2 | 2/2016 | Den Braber | |
| 9,402,363 | B1* | 8/2016 | Feitsma | .................... A01H 5/12 |
| 10,017,781 | B2 | 7/2018 | Torjek et al. | |
| 2005/0183150 | A1 | 8/2005 | Torisky et al. | |
| 2007/0204368 | A1 | 8/2007 | Dale | |
| 2009/0300786 | A1 | 12/2009 | Baerends | |
| 2009/0300788 | A1 | 12/2009 | Baerends | |
| 2010/0031385 | A1 | 2/2010 | Baerends | |
| 2012/0054894 | A1 | 3/2012 | Den Braber | |
| 2013/0055422 | A1 | 2/2013 | Baerends | |
| 2013/0055454 | A1 | 2/2013 | Den Braber | |
| 2013/0230635 | A1* | 9/2013 | den Braber | ........ C12N 15/8282 426/615 |
| 2014/0065287 | A1 | 3/2014 | Den Braber | |
| 2014/0068799 | A1 | 3/2014 | Den Braber | |
| 2014/0068801 | A1 | 3/2014 | Den Braber | |
| 2014/0068804 | A1 | 3/2014 | Den Braber | |
| 2014/0068805 | A1 | 3/2014 | Den Braber | |
| 2014/0068806 | A1 | 3/2014 | Den Braber | |
| 2015/0082483 | A1* | 3/2015 | Dijkstra | .................... A01H 5/12 800/279 |
| 2015/0101073 | A1 | 4/2015 | Brugmans et al. | |
| 2015/0240256 | A1 | 8/2015 | Brugmans et al. | |
| 2016/0152999 | A1 | 6/2016 | Torjek et al. | |
| 2016/0177330 | A1* | 6/2016 | Dijkstra | ............. C12N 15/8282 800/265 |
| 2017/0027126 | A1 | 2/2017 | Dijkstra et al. | |
| 2017/0027127 | A1 | 2/2017 | Dijkstra et al. | |
| 2017/0327839 | A1* | 11/2017 | Feitsma et al. | .......... A01H 5/12 |
| 2018/0042198 | A1 | 2/2018 | Feitsma | |
| 2019/0127753 | A1 | 5/2019 | Kock | |
| 2019/0233841 | A1* | 8/2019 | Kock et al. | ............. A01H 6/028 |
| 2020/0017875 | A1* | 1/2020 | Kock et al. | ............. A01H 6/028 |

FOREIGN PATENT DOCUMENTS

| DE | 10 2013 010026 A1 | 12/2014 |
| EP | 2848114 A1 | 3/2015 |
| EP | 2912940 A1 | 9/2015 |
| WO | 2013/064436 A1 | 5/2013 |

(Continued)

OTHER PUBLICATIONS

Irish et al. (2007) Plant Dis 91:1392-96.*
Irish et al. (2008) Phytopath 90(8):894-900.*
Correll et al. (2011) Eur J Plant Pathol 129:193-205.*
Qi & Innes (2013) Front Immunol 4:348.*
Dodds et al. (2001) Plant Cell 13:163-78.*
Sukarta et al. (2016) Sem Cell Devol Biol 56:134-49.*
Bentham et al. (2017) Annals Bot 119:689-702.*
Chakraborty et al. (2018) Plant Sci 269:85-93.*
Eitas & Dangl (2010) Curr Opin Plant Biol 13:472-77.*
She et al. (2018) Theor Appl Genet 131:2529-41.*
International Search Report and Written Opinion dated Jan. 30, 2018 in PCT/EP2017/074863.
2011 APS-IPPC Joint Meeting Abstracts of Presentations, Phytopathology (2011) 101(6) Supplemental, S1, S52.

(Continued)

*Primary Examiner* — Russell T Boggs
(74) *Attorney, Agent, or Firm* — Duane Morris LLP; Thomas J. Kowalski; Deborah L. Lu

(57) ABSTRACT

The present invention relates to a method for modifying the resistance profile of a spinach plant to *Peronospora farinosa* f. sp. *spinaciae*, comprising introducing a WOLF allele or a resistance-conferring part thereof into the genome of said spinach plant, or modifying an endogenous WOLF allele in the genome of said spinach plant. The invention further provides a method for selecting a spinach plant comprising a novel WOLF gene that confers resistance to *Peronospora farinosa* f. sp. *spinaciae* in a spinach plant and a method for identifying a WOLF allele that confers resistance to one or more pathogenic races of *Peronospora farinosa* f. sp. *spinaciae* in a spinach plant and to primers for use in these methods.

7 Claims, 2 Drawing Sheets

Specification includes a Sequence Listing.

(56) References Cited

FOREIGN PATENT DOCUMENTS

| WO | 2015/036378 A1 | 3/2015 |
| WO | 2015/036469 A1 | 3/2015 |
| WO | 2018/059653 A1 | 4/2018 |

OTHER PUBLICATIONS

Adam Bentham, et al., Animal NLRs Provide Structural Insights into Plant NLF Function, Annals of Botany (2017) 119:689-702.
Joydeep Chakraborty, et al., Functional Diversification of Structurally Alike NLR Proteins in Plants, Plant Science (2018) 269:85-93.
Peter N. Dodds, et al., Six Amino Acid Changes Confined to the Leucine-Rich Repeat β-Strand/β-Turn Motif Determine the Difference between the P and P2 Rust Resistance Specificities in Flax, The Plant Cell (Jan. 2001) vol. 13. p. 163-178.
Timothy K. Eitas, et al., NB-LRR Proteins: Pairs, Pieces, Perception, Partners, and Pathways, Current Opinion in Plant Biology (2010) 13:472-477.
Feng, et al., Identification of New Races and Deviating Strains of the Spinach Downy Mildew Pathogen *Peronospora farinosa* f sp. spinaciae, Plant Disease (Jan. 2014) 98(1):145-152.
GenBank Accession No. XP_021842255 (Aug. 1, 2017).
Haiwei H. Guo, et al., Protein Tolerance to Random Amino Acid Change, PNAS (Jun. 22, 2004) vol. 101, No. 25, p. 9205-9210.
Charlotte Hallavant, et al., The First Archaeobotanical Evidence of *Spinacia oleracea* L. (Spinach) in Late 12th-mid 13th Century A.D. France, French National Centre for Scientific Research. Article: Vegetation History and Archaeobotany, Published online May 21, 2013.
B. M. Irish, et al., Three New Races of the Spinach Downy Mildew Pathogen Identified by a Modified Set of Spinach Differentials, Plant Disease (Nov. 2007) vol. 91, No. 11, p. 1392-1396.
Merriam Webster Definition of "as" Sep. 27, 2016.
Simona Proietti, et al., Increase of Ascorbic Acid Content and Nutritional Quality in Spinach Leaves During Physiological Acclimation to Low Temperature, Plant Physiology and Biochemistry (2009) vol. 47, p. 717-723.
Dong Qi, et al., Recent Advances in Plant NLR Structure, Function, Localization, and Signaling, Frontiers in Immunology (2013) vol. 4, Article 348, p. 1-10.
Hongbing She, et al., Fine Mapping and Candidate Gene Screening of the Downy Mildew Resistance Gene RPF1 in Spinach, Theoretical and Applied Genetics (2018) 131:2529-2541.
Octavina C.A. Sukarta, et al., Structure-Informed Insights for NLR Functioning in Plant Immunity, Seminars in Cell & Developmental Biology (2016) 56:134-149.
Yanming Yang, et al., Transgenic Spinach Plants Expressing the Coat Protein of Cucumber Mosaic Virus, In Vitro Cell Dev. Biol.-Plant (1997) 33:200-204.
J.C. Correll, et al., Spinach: Better Management of Downy Mildew and White Rust Through Genomics, Eur. J. Plant Pathology (Dec. 4, 2010) 129:193-205.
Feng Chunda, et al., Construction of a Spinach Bacterial Artificial Chromosome (BAC) Library as a Resource for Gene Identification and Marker Development, Plant Mol Biol Rep (2015) 33:1996-2005.
B. M. Irish, et al., Characterization of a Resistance Locus (Pfs-1) to the Spinach Downy Mildew Pathogen (*Peronospora farinose* f. sp. spinaciae) and Development of a Molecular Marker Linked to Pfs-1, Pathology, American Phytopathological Society, US (2008) vol. 98, No. 8, p. 894-900.
"Identification of New Races and Deviating Strains of The Spinach Downy Mildew Pathogen *Peronospora farinose* F.Sp. Spinaciae," Chunda Feng et al., Plant Disease, pp. 145-152, Jan. 2014.†
"Interaction Between Domain of a Plant NBS-LRR Protein in Disease Resistance-Related Cell Death," Perter Moffett et al., The EMBO Journal, vol. 21, No. 17, pp. 4511-4519, 2002.†
"Spinach: Better Management of Downy Mildew and White Rush Through Genomics," James C. Correll et al., European Journal of Plant Pathology, pp. 193-205, Feb. 2011.†

\* cited by examiner
† cited by third party

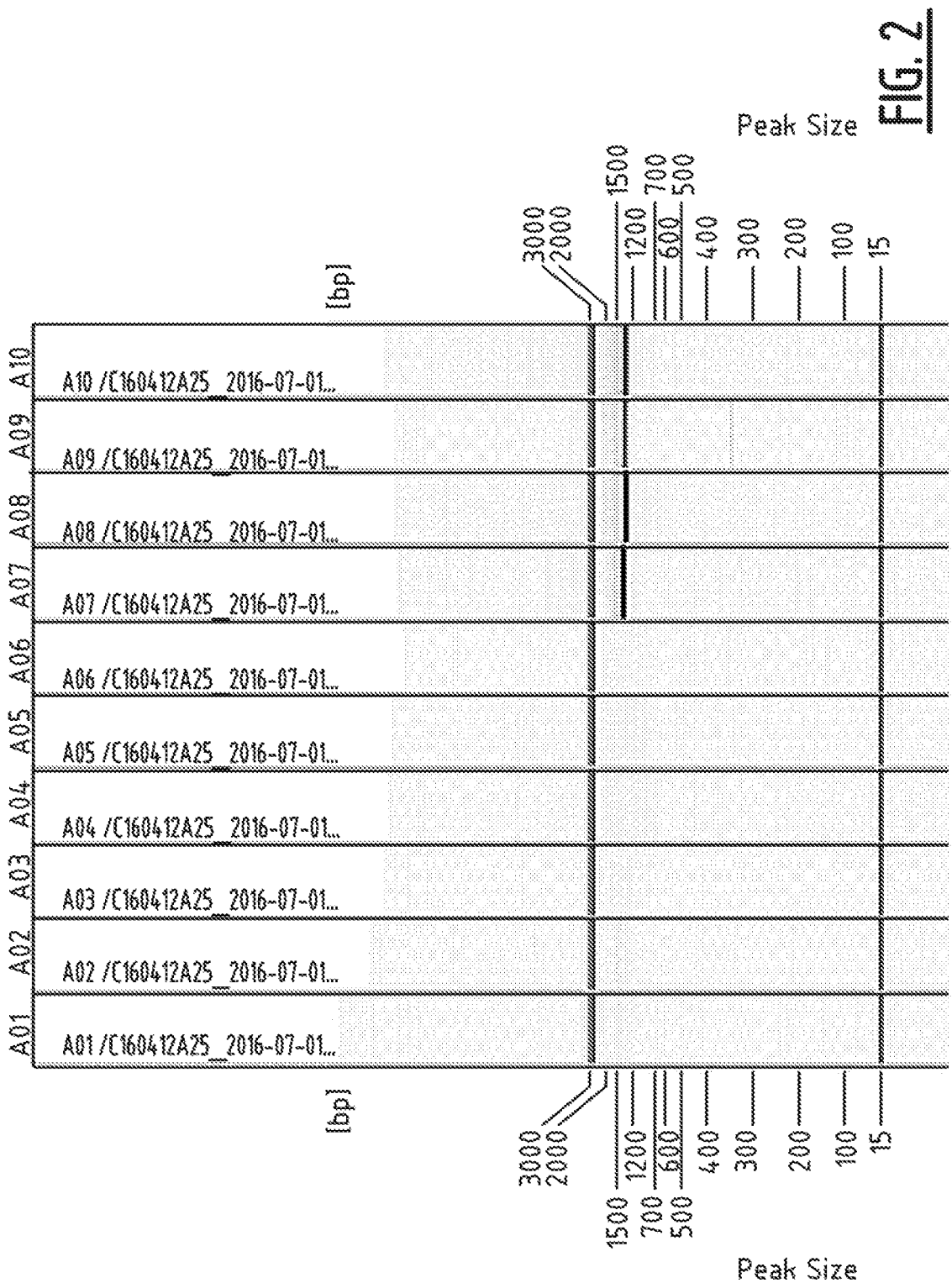

METHOD FOR MODIFYING THE RESISTANCE PROFILE OF *SPINACIA OLERACEA* TO DOWNY MILDEW

RELATED APPLICATIONS AND INCORPORATION BY REFERENCE

This application is a continuation-in-part application of international patent application Serial No. PCT/EP2017/074863 filed 29 Sep. 2017, which published as PCT Publication No. WO 2018/060474 A1 on 5 Apr. 2018, which claims benefit of international patent application Serial No. PCT/EP2016/001621 filed 30 Sep. 2016.

The foregoing applications, and all documents cited therein or during their prosecution ("appln cited documents") and all documents cited or referenced in the appln cited documents, and all documents cited or referenced herein ("herein cited documents"), and all documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

SEQUENCE STATEMENT

The instant application contains a Sequence Listing which has been submitted electronically and is hereby incorporated by reference in its entirety. Said ASCII copy, is named Y795400421SL.txt and is 916 Kbytes in size.

FIELD OF THE INVENTION

The invention relates to a method for modifying the resistance profile to *Peronospora farinosa* f. sp. *spinaciae* in a spinach plant (*Spinacia oleracea*). The invention also relates to plants with a modified resistance profile, to propagation material of said spinach plant, to a cell of said spinach plant, to seed of said spinach plant, and to harvested leaves of said spinach plant. This invention further relates to a method for selecting a spinach plant which may comprise an allele that confers resistance to *Peronospora farinosa* f. sp. *spinaciae* in a spinach plant. This invention also relates to a method for identifying an allele that confers resistance to one or more pathogenic races of *Peronospora farinosa* f. sp. *spinaciae* in a spinach plant, to a primer pair for amplifying at least part of such an allele from the genome of a spinach plant, and to the use of such an allele or part thereof as a marker in breeding or in producing a spinach plant that is resistant to *Peronospora farinosa* f. sp. *spinaciae*. The invention also relates to *Peronospora farinosa* f. sp. *spinaciae* resistance-conferring alleles.

BACKGROUND OF THE INVENTION

Spinach (*Spinacia oleracea*) is a flowering plant from the Amaranthaceae family that is grown as a vegetable. The consumable parts of spinach are the leaves from the vegetative stage. Spinach is sold loose, bunched, in pre-packed bags, canned, or frozen. There are three basic types of spinach, namely the savoy, semi-savoy and smooth types. Savoy has dark green, crinkly and curly leaves. Flat or smooth leaf spinach has broad, smooth leaves. Semi-savoy is a variety with slightly crinkled leaves. The main market for spinach is baby-leaf Baby spinach leaves are usually of the flat-leaf variety and usually the harvested leaves are not longer than about eight centimetres. These tender, sweet leaves are sold loose rather than in bunches. They are often used in salads, but can also be lightly cooked.

Downy mildew—in spinach caused by the oomycete fungus *Peronospora farinosa* f. sp. *spinaciae* (formerly known as *Peronospora effusa*)—is a major threat for spinach growers, because it affects the harvested plant parts, namely the leaves. Infection is economically devastating, as it makes the leaves unsuitable for sale and consumption, as it manifests itself phenotypically as yellow lesions on the older leaves, and on the abaxial leaf surface a greyish fungal growth can be observed. The infection can spread very rapidly, and it can occur both in glasshouse cultivation and in soil cultivation. The optimal temperature for formation and germination of *Peronospora farinosa* f. sp. *spinaciae* spores is 9 to 12° C., and it is facilitated by a high relative humidity. When spores are deposited on a humid leaf surface they can readily germinate and infect the leaf. Fungal growth is optimal between 8 and 20° C. and a relative humidity of >80%, and within 6 and 13 days after infection mycelium growth can be observed. Oospores of *Peronospora farinosa* can survive in the soil for up to 3 years, or as mycelium in seeds or living plants.

In recent years various resistance genes (so-called R-genes) have been identified that provide spinach plants with a resistance against downy mildew. However, it has been observed that previously resistant spinach cultivars can again become susceptible to the fungus. Investigations revealed that the cultivars themselves had not changed, and that the loss of downy mildew resistance must therefore be due to *Peronospora farinosa* overcoming the resistance in these spinach cultivars. The downy mildew races (also called physios, pathogenic races, or isolates) that were able to infect resistant spinach cultivars were collected in a differential reference set, which can be used to test spinach cultivars for resistance. The differential set comprises a series of spinach cultivars (hybrids) that have different resistance profiles to the currently identified pathogenic races.

Even though R-genes are extensively used in spinach breeding, until now not much is known of these R-genes. The R-genes present in the current commercial spinach varieties have never been characterized at the molecular level, i.e. their genomic sequence until now was unknown. Up until now there are no closely linked molecular markers known in the art that separate these R-genes, nor are the molecular characteristics of the genes themselves known in the art. Therefore, the search for new R-genes and R-gene identification is currently based on phenotypic assays in which many accessions are screened for possible variation in their resistance pattern. Subsequently it has to be determined through crossing and selection whether a newly observed resistance is in fact caused by an R-gene.

To date 16 pathogenic races of spinach downy mildew (Pfs) have been officially identified and characterized. Races 4 through 10 have been identified between 1990 and 2009 (Irish et al., 2008, *Phytopathol.* 98: 894-900), which illustrates the versatility and adaptability of the fungus to overcome resistances in spinach. In different geographical regions different combinations of pathogenic races occur, and the spinach industry therefore has a strong demand for spinach cultivars that are resistant to as many relevant downy mildew races as possible, preferably to all races that may occur in their region, and even to the newest threats that cannot be countered with the resistances that are present in the commercially available spinach cultivars.

In March and August 2011, the "International Working Group on *Peronospora farinosa*" (IWGP) designated two isolates as the type isolates for new races Pfs12 and Pfs13, respectively. As illustrated by Table 1, these newly identified *Peronospora* races can break the resistance of many spinach varieties that are currently used commercially worldwide, and they thus pose a serious threat to the productivity of the spinach industry. Since 2012, three new *Peronospora* isolates have been officially named as pathogenic races: UA4410 has been termed Pfs14 in 2012, UA4712 has been named Pfs15 in 2014, and UA1519B has become Pfs16 in 2016.

These 16 officially recognised Pfs races are all publicly available from the Department of Plant Pathology, University of Arkansas, Fayetteville, Ark. 72701, USA, and also from NAK Tuinbouw, Sotaweg 22, 2371 GD Roelofarendsveen, the Netherlands.

Spinach variety Viroflay is an example of a spinach line that is susceptible to all known *Peronospora farinosa* f. sp. *spinaciae* physios, while cultivars such as Lion and Lazio show resistance to multiple pathogenic races. However, it is crucial to stay at the forefront of developments in this field, as *Peronospora* continuously develops the ability to break the resistances that are present in commercial spinach varieties. For this reason new resistance genes are very valuable assets, and they form an important research focus in spinach breeding. The goal of spinach breeders is to rapidly develop spinach varieties with a resistance to as many *Peronospora farinosa* races as possible, including the latest identified races, before these races become wide-spread and can threaten the industry.

In the prior art no single resistance gene (R-gene) is known that confers resistance to all the known physios. In the absence of a suitable resistance to counter this pathogenic threat, especially the new isolates may spread during the next growing seasons and cause great damage to the worldwide spinach industry in the immediate future. It is thus necessary to be able to stack different resistance genes against *Peronospora* infection in spinach in order to confer a resistance that is as broad as possible, i.e. that confers resistance to as many Pfs races as possible, preferable to all known Pfs races.

Citation or identification of any document in this application is not an admission that such document is available as prior art to the present invention.

SUMMARY OF THE INVENTION

Therefore, it is an object of the invention to provide a method for modifying the resistance profile of a spinach plant to *Peronospora farinosa* f. sp. *spinaciae*, such that a spinach plant becomes resistant to various pathogenic races of *Peronospora farinosa* f. sp. *spinaciae*, including the ones that have been most recently identified, and preferably also the ones that will be identified in the future.

Another object of the invention is to provide a method for selecting a spinach plant which may comprise a gene that confers resistance to *Peronospora farinosa* f. sp. *spinaciae* with the purpose of identifying novel sources of resistance genes against various pathogenic races of *Peronospora farinosa* f. sp. *spinaciae*. Such pathogenic races include the ones that have been most recently identified, and preferably also the ones that will be identified in the future.

A further object of the invention is to provide a method for identifying a gene that confers resistance to one or more pathogenic races of *Peronospora farinosa* f. sp. *spinaciae* in a spinach plant.

In the research leading to the present invention, it was found that different resistance genes that confer resistance to *Peronospora farinosa* f. sp. *spinaciae* in spinach are not separate resistance loci, as had been previously assumed, but that they are different alleles of the same one or two genes. These one or two genes, which are either "alpha-WOLF" type or "beta-WOLF" type of genes (together referred to as "the WOLF genes") each encode a protein that belongs to the CC-NBS-LRR family (Coiled Coil—Nucleotide Binding Site—Leucine-Rich Repeat). Depending on the allelic variant (or the allelic variants) that is (are) present in a spinach plant, said plant will produce a variant of the WOLF protein that confers a certain resistance profile to pathogenic races of *Peronospora farinosa* f. sp. *spinaciae*. The research leading to the present invention has furthermore elucidated the relationship between the different alleles present in the genome of a spinach plant and the resistance profile of said plant to a number of different pathogenic races of *Peronospora farinosa* f. sp. *spinaciae*.

In the context of this invention the term "allele" or "allelic variant" is used to designate a version of the gene that is linked to a specific phenotype, i.e. resistance profile.

It was found that a spinach plant may carry one or two WOLF genes. Each of these two WOLF genes encompasses multiple alleles, each allele conferring a particular resistance profile. The beta WOLF gene is located on scaffold12735 (sequence: GenBank: KQ143339.1), at position 213573-221884. In case the spinach plant also carries or only carries the alpha-WOLF gene, the alpha-WOLF gene is located at approximately the same location as where the beta-WOLF gene is located on scaffold12735 in the Viroflay genome assembly. Many different alleles were sequenced by the present inventors and their sequences are provided herein.

Based on this finding it becomes now possible to design a desired resistance profile by combining alleles with different profiles. In breeding the design of resistance profiles has been done on the basis of the phenotype, i.e. the resistances observed in spinach plants, but the invention enables combinations to be made on the basis of genotype, for example by using the sequence information provided herein for developing markers. In addition, the invention now enables tailor-made spinach plants that carry more than one or two WOLF genes by either introducing additional alleles by means of transgenesis and/or by modifying endogenous alleles to produce variants that confers desired resistance profiles.

The invention thus relates to a method for modifying the resistance profile of a spinach plant to *Peronospora farinosa* f. sp. *spinaciae*, which may comprise introducing a WOLF allele or a resistance-conferring part thereof into the genome of said spinach plant and/or modifying an endogenous WOLF allele in the genome of said spinach plant.

The invention further relates to a method for selecting a spinach plant which may comprise a novel WOLF allele that confers resistance to *Peronospora farinosa* f. sp. *spinaciae* in a spinach plant, which may comprise:

a) determining the sequence of the LRR domain or part thereof of a WOLF allele in the genome of a spinach plant;

b) comparing said sequence to the sequences in Table 3; and c) if the sequence is substantially different from the sequences in Table 3, select the spinach plant that harbours said sequence in its genome as a spinach plant that may comprise a novel WOLF allele.

The invention according to a further aspect thereof relates to a method for identifying a WOLF allele that confers resistance to one or more pathogenic races of *Peronospora farinosa* f. sp. *spinaciae* in a spinach plant, which may comprise:

a) phenotypically selecting a spinach plant that is resistant to one or more pathogenic races of *Peronospora farinosa* f. sp. *spinaciae;* b) determining the sequence of the LRR domain or part thereof of a WOLF allele that is present in the genome of said spinach plant, and c) optionally comparing the sequence to a reference sequence representing the WOLF allele to be identified.

The invention also relates to a WOLF allele having a genomic or cDNA sequence listed in Table 3 and to a WOLF protein having an amino acid sequence as listed in Table 3.

The invention also relates to the use of a WOLF allele or part thereof as a marker in breeding, or in producing a spinach plant that is resistant to *Peronospora farinosa* f. sp. *spinaciae.*

Accordingly, it is an object of the invention not to encompass within the invention any previously known product, process of making the product, or method of using the product such that Applicants reserve the right and hereby disclose a disclaimer of any previously known product, process, or method. It is further noted that the invention does not intend to encompass within the scope of the invention any product, process, or making of the product or method of using the product, which does not meet the written description and enablement requirements of the USPTO (35 U.S.C. § 112, first paragraph) or the EPO (Article 83 of the EPC), such that Applicants reserve the right and hereby disclose a disclaimer of any previously described product, process of making the product, or method of using the product. It may be advantageous in the practice of the invention to be in compliance with Art. 53(c) EPC and Rule 28(b) and (c) EPC. All rights to explicitly disclaim any embodiments that are the subject of any granted patent(s) of applicant in the lineage of this application or in any other lineage or in any prior filed application of any third party is explicitly reserved. Nothing herein is to be construed as a promise.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention.

These and other embodiments are disclosed or are obvious from and encompassed by, the following Detailed Description.

DEPOSITS

Seeds of plants comprising the different alpha- and beta WOLF alleles of the invention were deposited with NCIMB Ltd, Ferguson Building, Craibstone Estate, Buckburn, Aberdeen AB21 9YA, UK, on Sep. 9, 2016, under deposit accession numbers 42642-42656, except for seeds of a plant comprising the alpha-WOLF 15 allele, those were deposited with NCIMB Ltd, Ferguson Building, Craibstone Estate, Buckburn, Aberdeen AB21 9YA, UK, on Oct. 15, 2015, under accession number NCIMB 42466. Seeds of plants comprising the alpha-WOLF alleles 16 to 20 were deposited with NCIMB Ltd, Ferguson Building, Craibstone Estate, Buckburn, Aberdeen AB21 9YA, UK, on Sep. 28, 2017, under deposit accession numbers 42818-42822.

The Deposits with NCIMB Ltd, under deposit accession numbers 42466 and 42818-42822 were made pursuant to the terms of the Budapest Treaty. Upon issuance of a patent, all restrictions upon the deposit will be removed, and the deposit is intended to meet the requirements of 37 CFR §§ 1.801-1.809. The deposit will be irrevocably and without restriction or condition released to the public upon the issuance of a patent and for the enforceable life of the patent. The deposit will be maintained in the depository for a period of 30 years, or 5 years after the last request, or for the effective life of the patent, whichever is longer, and will be replaced if necessary during that period.

BRIEF DESCRIPTION OF THE DRAWINGS

The following detailed description, given by way of example, but not intended to limit the invention solely to the specific embodiments described, may best be understood in conjunction with the accompanying drawings.

FIG. 2: agarose gel showing PCR amplicons from beta-type WOLF alleles, amplified from genetically different spinach plants. Each lane shows the PCR product that was obtained from a different spinach plant, using primer pairs comprising sequences SEQ ID NO:3 and SEQ ID NO:2. The sequence of each PCR fragment was subsequently determined using SMRT sequencing. Several of the tested plants did not harbour any beta-type WOLF genes in their genome.

DETAILED DESCRIPTION OF THE INVENTION

Figure 1:
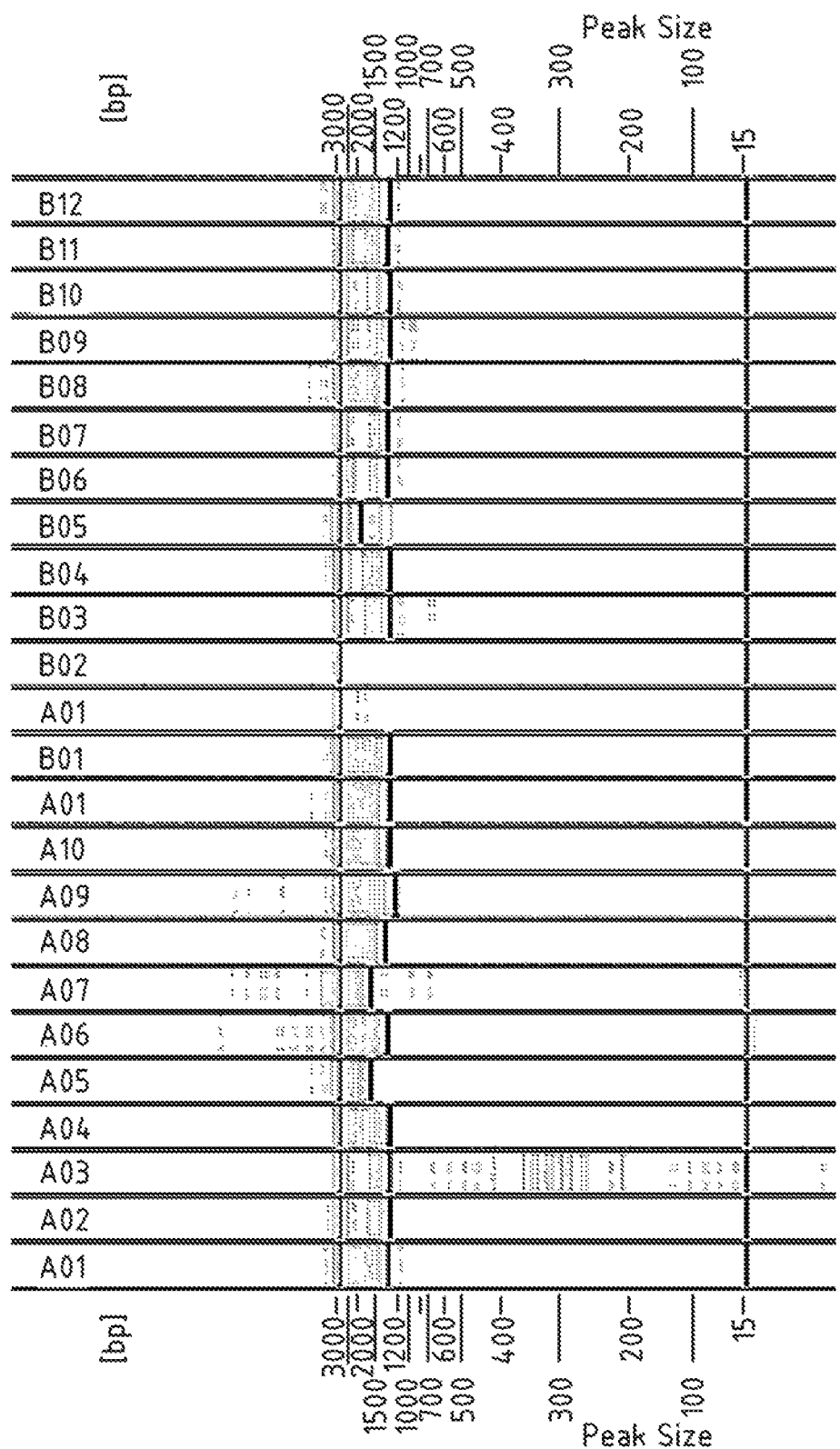
FIG. 1: agarose gel showing PCR amplicons of alpha-type WOLF alleles, amplified from genetically different spinach plants. Each lane shows the PCR product that was obtained from a different spinach plant, using primer pairs comprising sequences SEQ ID NO:1 and SEQ ID NO:2. The sequence of each PCR fragment was subsequently determined using SMRT sequencing.

The invention thus relates to a method for modifying the resistance profile of a spinach plant to *Peronospora farinosa* f. sp. *spinaciae,* which may comprise introducing a WOLF allele or a resistance-conferring part thereof into the genome of said spinach plant and/or modifying an endogenous WOLF allele in the genome of said spinach plant.

A genome assembly for spinach variety Viroflay—which is susceptible to all known pathogenic races of *Peronospora farinosa* f. sp. *spinaciae*—is publicly available (*Spinacia oleracea* cultivar SynViroflay, whole genome shotgun sequencing project; Bioproject: PRJNA41497; GenBank: AYZV00000000.2; BioSample: SAMN02182572, see also Dohm et al, 2014, *Nature* 505: 546-549). In this genome assembly for Viroflay, a beta-WOLF gene is located on scaffold12735 (sequence: GenBank: KQ143339.1), at position 213573-221884. The sequence covered by this interval may comprise the entire genomic sequence of the beta-WOLF gene of Viroflay, plus 2000 basepairs sequence upstream from the gene, plus the sequence downstream from the gene, up to the locus of the neighbouring gene that is situated downstream from the WOLF gene. Importantly, however, the amino acid sequence that is encoded by the beta-WOLF gene that is present in the genome of spinach line Viroflay had been incorrectly predicted in the publicly available genome assembly. In the research leading to the present invention, RNA information has been used to correct the predicted gene model of said beta-WOLF gene, and to correctly predict the encoded amino acid sequence. The correct amino acid sequence of the beta-WOLF allele from Viroflay is represented by SEQ ID NO:7. The WOLF allele of Viroflay is a so-called RO allele, which means that the allele of the beta-type WOLF gene present in the genome of Viroflay does not confer resistance to downy mildew. Allelic variants of the WOLF gene that do not confer downy mildew resistance are not part of the invention.

Spinach variety Viroflay only possesses a single WOLF gene, namely a beta-WOLF gene, but many other spinach lines harbour a single alpha-type WOLF gene at the same location in the genome. Other spinach lines harbour two or more WOLF genes at the same location in the genome. In such cases, the two or more WOLF genes are positioned adjacent to each other. In spinach lines that harbour two or more WOLF genes, said WOLF genes belong to the alpha-type and/or to the beta-type. We have observed the combination of one alpha-type WOLF gene and one beta-type WOLF gene, and of two beta-type WOLF genes. Combinations of two or more alpha-type WOLF genes are also possible.

In the research leading to the present invention, it was observed that allelic variation in the WOLF gene or genes is responsible for differences in the resistance profile of a spinach plant to pathogenic races of *Peronospora farinosa* f. sp. *spinaciae*.

The difference between an alpha-WOLF gene and a beta-WOLF gene lies in the presence of specific conserved amino acid motifs in the encoded protein sequence. As mentioned above, all WOLF proteins are NBS-LRR proteins and consequently possess—from N- to C-terminus—the following domains that are generally known in the art: a coiled coil domain (RX-CC-like, cd14798), an NBS domain (also referred to as "NB-ARC domain", pfam00931; van der Biezen & Jones, 1998, *Curr. Biol.* 8: R226-R228), and leucine-rich repeats (IPR032675) which encompass the LRR domain. In addition, all WOLF proteins may comprise in their amino acid sequence the motif "MAEIGYSVC" (SEQ ID NO:171) at the N-terminus. In addition to this, all alpha-WOLF proteins may comprise the motif "KWMCLR" (SEQ ID NO:172) in their amino acid sequence, whereas all beta-WOLF proteins may comprise the motif "HVGCVVDR" (SEQ ID NO:173) in their amino acid sequence. These motifs distinguish WOLF proteins from all other NBS-LRR proteins. All alpha-WOLF proteins and some of the beta-WOLF proteins may further comprise an additional motif in their amino acid sequence, namely "(E/D)DQEDEGE" (SEQ ID NO:174/175).

The resistance profile to *Peronospora farinosa* f. sp. *spinaciae* of a spinach plant is suitably determined by means of an assay, of which an example is given in Example 1. In this assay, the resistance of a spinach plant is tested against all officially recognised pathogenic races of *Peronospora farinosa* f. sp. *spinaciae*, and a standard differential set of spinach plants is used as a reference. For the plants of the differential set, the response to each of the pathogenic races has been well studied, which is illustrated by Table 1.

The present invention according to a first aspect thereof involves the introduction of a nucleic acid into a plant.

In one embodiment, introducing a WOLF allele or a resistance-conferring part thereof into the genome of a spinach plant is achieved by means of traditional breeding techniques, through crossing and selecting.

In another embodiment, introducing a WOLF allele or a resistance-conferring part thereof into the genome of a spinach plant may comprise the step of transforming a spinach cell with a nucleic acid construct which may comprise a coding sequence encoding one or more WOLF polypeptides. Suitably, the thus genetically modified spinach cell is regenerated into a spinach plant. In this embodiment, "introducing" is intended to mean providing the nucleic acid construct to the plant in such a manner that the nucleic acid construct gains access to the interior of a cell of the plant, more preferably to the nucleus of said cell, and is capable of being expressed in the cell. Such expression can be stable or transient.

In a preferred embodiment, said nucleic acid construct is designed for stable incorporation into the genome of a spinach cell. In this embodiment, said nucleic acid construct is fused into a plant transformation vector suitable for the stable incorporation of the nucleic acid construct into the genome of a plant cell. Typically, the stably transformed plant cell will be regenerated into a transformed plant that may comprise in its genome the nucleic acid construct. Such a stably transformed plant is capable of transmitting the nucleic acid construct to progeny plants in subsequent generations via sexual and/or asexual reproduction. Plant transformation vectors, methods for stably transforming plants with an introduced nucleic acid construct and methods for plant regeneration from transformed plant cells and tissues are generally known in the art. Any available plant transformation vector can be used in the context of this invention.

In one embodiment, the nucleic acid construct is stably integrated into the genome of a spinach cell at a location that is genetically linked with the endogenous WOLF locus. The endogenous WOLF gene locus is on scaffold12735, as has been described in detail above, and a location that is genetically linked with the endogenous WOLF gene locus is thus, for example, a location on the same chromosome that is close enough to make frequent meiotic recombination unlikely. This is, for example, immediately adjacent to the endogenous WOLF gene locus, or within 1 cM distance, which implies that the recombination frequency between the endogenous WOLF gene locus and the integrated nucleic acid construct is maximally one percent. It should be noted that this example is not intended to limit the invention in any way, because a genetic distance of more than 1 cM could still be useful for breeding purposes.

The situation wherein a nucleic acid construct is stably integrated into the genome of a spinach cell at a location that is genetically linked with the endogenous WOLF gene locus, makes it easier to combine said nucleic acid construct with the endogenous WOLF gene locus of the transformed spinach plant during breeding. If, for example, said nucleic acid construct confers resistance to a subset of pathogenic races of *Peronospora farinosa* f. sp. *spinaciae*, and this nucleic acid construct is integrated at a location in the genome that is genetically linked with the endogenous WOLF gene locus of a spinach plant whose endogenous WOLF allele (or WOLF alleles) confers resistance to another subset of pathogenic races of the same pathogen, then the resistance profile of the modified plant and its progeny is much broader than that of each of the original plants before modification. The nucleic acid construct and the endogenous WOLF gene locus are inherited as a single locus, which makes it easier to use the combination of both in breeding.

In an alternative embodiment, the nucleic acid construct is stably integrated into the genome of a spinach cell at a location that is not genetically linked with the endogenous WOLF gene locus. The endogenous WOLF gene locus is located on scaffold12735, as has been described in detail above, and a location that is not genetically linked therewith is thus, for example, another chromosome than the chromosome on which scaffold12735 is located, or a location on that chromosome that is distant enough from the endogenous WOLF gene locus such that meiotic recombination may frequently occur between the inserted nucleic acid construct and the endogenous WOLF gene locus. This situation makes it easier to combine said nucleic acid construct with the endogenous WOLF gene locus of other spinach plants during breeding. If, for example, said nucleic acid construct confers resistance to a subset of pathogenic races of *Peronospora farinosa* f. sp. *spinaciae*, a spinach plant harbouring said nucleic acid construct when crossed with another spinach plant whose endogenous WOLF allele (or WOLF alleles) confers resistance to another subset of pathogenic races of the same pathogen, then the resistance profile of the progeny from this cross is much broader than that of each of its original parents, if the endogenous WOLF allele (or WOLF alleles) and the nucleic acid construct that may comprise another WOLF allele are both present in its genome.

Stable transformation may be achieved using any suitable method known in the art. For spinach, specific protocols have been developed for stable transformation. For example, efficient *Agrobacterium*-mediated transformation protocols have been developed for spinach (Zhang and Zeevaart, 1999, *Plant Cell Rep* 18: 640-645; Chin et al, 2009, *Plant Biotechnol* 26: 243-248; Naderi et al, 2012, *Adv Biosci Biotechnol* 3: 876-880).

For stable integration of a WOLF allele encoding a WOLF polypeptide in a spinach plant, a nucleic acid sequence which may comprise a coding sequence encoding one or more WOLF polypeptides can be provided in an expression cassette for expression in a spinach plant. The cassette includes 5' and 3' regulatory sequences operably linked to the coding region of said gene, or to the genomic locus of said gene. More specifically, the nucleic acid sequence which may comprise a coding sequence encoding a WOLF polypeptide is at its 5' end operably linked to a promoter sequence that is capable of driving gene expression in a plant cell, and more specifically in a spinach cell. At its 3' end, it is operably linked to a suitable terminator sequence that is operational in a plant cell, and more specifically in a spinach cell.

"Operably linked" is intended to mean a functional linkage between two or more elements, for example between a polynucleotide or gene of interest and regulatory sequences, such as a promoter. Said functional linkage ensures that the polynucleotide or gene of interest is expressed in a plant cell. Operably linked elements may be contiguous or non-contiguous. When referring to the joining of two protein encoding regions, "operably linked" in intended to mean that the coding regions are in the same reading frame. The expression cassette may contain at least one additional gene to be co-transformed into the plant cell, such as a reporter gene or a selection marker (to allow for a convenient selection of transformed cells or plants, by means of treatment with, for example, a herbicide or an antibiotic). Additional genes may also be provided on multiple expression cassettes. An expression cassette typically may comprise a plurality of restriction sites and/or recombination sites for insertion of a coding sequence, such that it becomes operably linked to regulatory regions that were already present in said cassette. The expression cassette may additionally contain selectable marker genes, such as genes conferring resistance to herbicides (such as glufosinate, bromoxynil, imidazolinones, 2,4-dichlorophenoxyacetate), antibiotic resistance genes (such as neomycin phosphotransferase II, hygromycin phosphotransferase), or genes encoding fluorescent proteins such as Green Fluorescent Protein (Fetter et al, 2004, *Plant Cell* 16: 215-228), Yellow Fluorescent Protein (Bolte et al, 2004, *J. Cell Sci.* 117: 943-954), or a gene encoding beta-glucuronidase (GUS).

A typical expression cassette includes, in the 5' to 3' direction of transcription, a regulatory control sequence (i.e. a promoter) that ensures transcriptional and translational initiation in a plant cell, a coding region encoding one or more WOLF polypeptides according to the present invention, and a transcriptional and translational termination region that is functional in a spinach plant cell. The regulatory regions and/or the coding region may be native to the host cell (and/or derived from the same species), or they may be heterologous to the host cell (and/or derived from different species). More specifically, the regulatory regions and/or the coding region may all be derived from *Spinacia oleracea*, or they may be derived from a foreign plant species.

"Heterologous" is intended to mean that a sequence originates from a foreign species, or if it originates from the same species, it is substantially modified from its native form in composition and/or genomic locus, by human intervention. A chimeric gene is a gene which may comprise a coding sequence operably linked to a promoter that is heterologous to the coding sequence. The termination region may originate from the same source as the promoter, it may originate from the same source as the operably linked coding region, it may originate from the same source as the host cell, or it may have been derived from a different source as the promoter, the coding region, the host cell, or any combination thereof. Widely used termination regions are, for example, available from the Ti plasmid of *Agrobacterium tumefaciens*, such as the octopine synthase and nopaline synthase termination regions.

Depending on the desired outcome, a number of different promoters can be used to drive expression of the nucleic acid of the invention. It may be desirable to express the one or more WOLF alleles encoding a WOLF polypeptide constitutively in the entire plant, using a promoter sequence that confers ubiquitous expression, but it may also be desirable to limit the transgene expression to a plant part or plant parts that are most likely to be attacked or infected by *Peronospora farinosa* f. sp. *spinaciae*, such as the leaves or cotyledons, using an organ-, tissue-of cell-type-specific promoter sequence. Also, it may be desirable to make the transgene expression inducible, such that the transgene expression is elevated or induced in response to an endogenous (developmental) and/or environmental (physical or biological) queue or trigger, or regulated by chemicals.

In one embodiment, the invention thus provides a nucleic acid construct which may comprise a coding region encoding one or more WOLF polypeptides, operably linked to a constitutive promoter sequence. Constitutive promoter sequences that can confer ubiquitous gene expression throughout a plant include, but are not limited to, 35S cauliflower mosaic virus (CaMV) promoter, opine promoters, ubiquitin promoters, actin promoters, tubulin promoters, alcohol dehydrogenase promoters, fragments thereof, or combinations of any of the foregoing.

In another embodiment, the invention provides a nucleic acid construct which may comprise a coding region encoding one or more WOLF polypeptides, operably linked to a leaf-specific promoter sequence. Non-limiting examples of leaf-specific plant promoters include the Zmglp1, PnGLP and PDX1 promoters. The promoter sequence can be wild type or it can be modified for more efficient or efficacious expression.

In another embodiment, the invention provides a nucleic acid construct which may comprise a coding region encoding one or more WOLF polypeptides, operably linked to an inducible promoter sequence. Examples of suitable inducible promoter sequences for plants include, but are not limited to, promoter sequences that are regulated by heat shock, pathogens, wounding, cold, drought, heavy metals, steroids (such as dexamethasone, beta-estradiol), antibiotics, or alcohols (such as ethanol).

In a preferred embodiment, the inducible promoter is pathogen-inducible and it confers a leaf-specific expression to the nucleic acid sequence to which it is operably linked, or an epidermis-specific expression, or a mesophyll-specific expression. This approach has the advantage that the transgenic plant does not need to constitutively express the transgene, which (depending on the strength of the promoter) may require a considerable investment of the plant's energy and resources, and which may result in deleterious effects caused by the highly and ectopically expressed polypeptide.

In a more preferred embodiment, the inducible promoter is inducible by oomycete pathogen infection, and it confers a leaf-specific expression to the nucleic acid sequence to which it is operably linked. Such promoter induces gene expression in response to infection of the plant by one or more oomycete pathogen, such as *Peronospora*. Most preferably, said promoter induces gene expression shortly after infection of the plant by an oomycete pathogen, and in plant cells that are at or in vicinity of the oomycete pathogen. "Shortly after" is intended to mean within about 1, 2, 3, 4, 5, 6, 7, 8, 9, 10, 11, 12, 18, 24 hours after infection of the plant or plant cell with the oomycete pathogen. Examples of pathogen-inducible promoters active in leaves include, but are not limited to, the promoters of pathogenesis-related (PR) protein genes, the promoters of SAR (systemic acquired resistance) genes, the promoters of beta-1,3-glucanase genes, the promoters of chitinase genes. Suitable information can be found in, for example, EP1056862; EP0759085; Uknes et al 1992 (*Plant Cell* 4: 645-656); Van Loon 1985 (*Plant Mol. Virol.* 4: 111-116); Redolfi et al 1983 (*Neth. J. Plant Pathol.* 89: 245-254); Marineau et al 1987 (*Plant Mol. Biol.* 9: 335-342); Matton et al 1987 (*Mol. Plant-Microbe Interactions* 2: 325-342); Somssich et al 1986 (*Proc. Natl. Acad. Sci USA* 83: 2427-2430); Somssich et al 1988 (*Mol. Gen. Genet.* 2: 93-98); Chen et al 1996 (*Plant J.* 10: 955-966); Zhang and Sing 1994 (*Proc. Natl. Acad. Sci. USA* 91: 2507-2511); Warner et al 1993 (*Plant J.* 3: 191-201); Siebertz et al 1989 (*Plant Cell* 1: 961-968).

Alternatively, the inducible promoter is inducible by wounding. Examples thereof include, for example, the promoter of the potato proteinase inhibitor (PIN II) gene (Ryan, 1990, *Annu. Rev. Phytopath.* 28: 425-449); the promoters of the WUN1 and WUN2 genes (U.S. Pat. No. 5,428,148); the promoters of the WIN1 and WIN2 genes (Stanford et al, 1989, *Mol. Gen. Genet.* 215: 200-208); the promoter of a systemin gene (McGurl et al, 1992, *Science* 225: 1570-1573).

In yet another embodiment, the invention provides a nucleic acid construct which may comprise a coding region encoding one or more WOLF polypeptides, operably linked to the endogenous promoter of a WOLF gene. The endogenous or native promoter is the promoter sequence that drives the expression of the WOLF gene in the spinach plant from which said gene has been isolated.

Alternatively, the endogenous promoter is the promoter sequence that drives the expression of an orthologue of said WOLF gene in the spinach plant into which the nucleic acid construct is introduced. An "orthologue" of a WOLF gene is a gene that is present in the genome of another plant, that has a high sequence similarity to other WOLF genes, and that has retained the same function. More specifically, said WOLF orthologue is present in the spinach genome at the WOLF gene locus, and it falls under the definition of a WOLF gene as described herein. The skilled person is familiar with methods for the calculation of sequence similarity. Suitably sequence similarity is calculated using EMBOSS stretcher 6.6.0 (www.ebi.ac.uk/Tools/psa/emboss_stretcher), using the EBLOSUM62 matrix and the resulting "similarity score".

Typically, the endogenous promoter sequence is located upstream of the 5' end of the coding sequence of the gene (i.e. upstream of the start codon of the gene), in the genome of the spinach plant from which said gene has been isolated. Preferably, the endogenous promoter also may comprise any 5'UTR sequences that may be present in the endogenous gene, to ensure that the expression pattern and responsiveness (inducibility) of the transgene resembles that of the endogenous gene as closely as possible. In this case, the 3' end of the endogenous promoter is thus situated immediately upstream from the encoded protein's ATG start codon. "Immediately upstream" is intended to mean that the promoter sequence ends one basepair upstream from said start codon, i.e. is immediately adjacent to the coding sequence. The actual length of a promoter is different for each gene, and the person skilled in the art of plant molecular biology generally knows how to select a promoter sequence for transgenic applications. Often the most important regulatory elements are located within about 500 bp upstream from the gene's ATG start codon, but important regulatory elements may also be present further upstream in the DNA. Arbitrarily, an experimenter usually defines the starting point of a gene's promoter at about 1000 bp, about 2000 bp or about 3000 bp upstream from the ATG start codon, but this choice is influenced by the location of upstream flanking genes. If the open reading frame of the gene that is adjacent to the WOLF gene of interest at the 5' end is situated within less than about 1000 bp, or less than about 2000 bp, or less than about 3000 bp upstream from the WOLF gene's ATG start codon, then the experimenter may decide to define the intergenic sequence (i.e. the sequence that is situated between the stop codon of the 5' flanking gene and the ATG start codon of the WOLF gene) as the promoter sequence of the WOLF gene, for use in transgenic applications.

In another embodiment, the invention relates to a method for modifying the resistance profile of a spinach plant to *Peronospora farinosa* f. sp. *spinaciae*, which may comprise modifying an endogenous WOLF allele in the genome of said spinach plant. Modifying the endogenous locus can for example be achieved by means of genome editing techniques or mutagenesis techniques.

Modification of the endogenous WOLF allele may comprise changing the endogenous allele of the WOLF gene into a WOLF allele with a known resistance profile, but it can also lead to a de novo allele conferring a novel resistance profile. Introducing a WOLF allele also encompasses introducing more than one WOLF allele. Such introduction may lead to plants with novel combinations of WOLF alleles. In case the one or more WOLF alleles are transgenically introduced into the genome of a plant it will be possible to develop plants that comprise more than two WOLF genes and thus more than four WOLF alleles.

In one embodiment, modifying an endogenous WOLF allele may comprise the step of targeted genome editing, wherein the sequence of an endogenous WOLF allele is modified, or wherein an endogenous WOLF allele is replaced by another WOLF allele that is optionally modified. This can be achieved by means of any method known in the art for modifying DNA in the genome of a plant, or by means of methods for gene replacement. Such methods include genome editing techniques and homologous recombination.

Homologous recombination allows the targeted insertion of a nucleic acid construct into a genome, and the targeting is based on the presence of unique sequences that flank the targeted integration site. For example, the endogenous locus of a WOLF gene could be replaced by a nucleic acid construct which may comprise a different WOLF allele and/or a modified WOLF allele.

The modification of the endogenous WOLF allele can be introduced by means of mutagenesis. Mutagenesis may comprise the random introduction of at least one modification by means of one or more chemical compounds, such as ethyl methanesulphonate (EMS), nitrosomethylurea, hydroxylamine, proflavine, N-methyl-N-nitrosoguanidine, N-ethyl-N-nitrosourea, N-methyl-N-nitro-nitrosoguanidine, diethyl sulphate, ethylene imine, sodium azide, formaline, urethane, phenol and ethylene oxide, and/or by physical means, such as UV-irradiation, fast-neutron exposure, X-rays, gamma irradiation, and/or by insertion of genetic elements, such as transposons, T-DNA, retroviral elements.

Modifying an endogenous WOLF allele can involve inducing double strand breaks in DNA using zinc-finger nucleases (ZFN), TAL (transcription activator-like) effector nucleases (TALEN), Clustered Regularly Interspaced Short Palindromic Repeats/CRISPR-associated nuclease (CRISPR/Cas nuclease), or homing endonucleases that have been engineered to make double-strand breaks at specific recognition sequences in the genome of a plant, another organism, or a host cell.

TAL effector nucleases (TALENs) can be used to make double-strand breaks at specific recognition sequences in the genome of a plant for gene modification or gene replacement through homologous recombination. TAL effector nucleases are a class of sequence-specific nucleases that can be used to make double-strand breaks at specific target sequences in the genome of a plant or other organism. TAL effector nucleases are created by fusing a native or engineered transcription activator-like (TAL) effector, or functional part thereof, to the catalytic domain of an endonuclease, such as, for example, Fok I. The unique, modular TAL effector DNA binding domain allows for the design of proteins with potentially any given DNA recognition specificity. Thus, the DNA binding domains of the TAL effector nucleases can be engineered to recognise specific DNA target sites and thus, used to make double-strand breaks at desired target sequences.

ZFNs can be used to make double-strand breaks at specific recognition sequences in the genome of a plant for gene modification or gene replacement through homologous recombination. The Zinc Finger Nuclease (ZFN) is a fusion protein which may comprise the part of the Fok I restriction endonuclease protein responsible for DNA cleavage and a zinc finger protein which recognizes specific, designed genomic sequences and cleaves the double-stranded DNA at those sequences, thereby producing free DNA ends (Urnov et al, 2010, *Nat. Rev. Genet.* 11:636-46; Carroll, 2011, *Genetics* 188:773-82).

The CRISPR/Cas nuclease system can also be used to make double-strand breaks at specific recognition sequences in the genome of a plant for gene modification or gene replacement through homologous recombination. The CRISPR/Cas nuclease system is an RNA-guided DNA endonuclease system performing sequence-specific double-stranded breaks in a DNA segment homologous to the designed RNA. It is possible to design the specificity of the sequence (Jinek et al, 2012, *Science* 337: 816-821; Cho et al, 2013, *Nat. Biotechnol.* 31:230-232; Cong et al, 2013, *Science* 339:819-823; Mali et al., 2013, *Science* 339:823-826; Feng et al, 2013, *Cell Res.* 23:1229-1232). Cas9 is an RNA-guided endonuclease that has the capacity to create double-stranded breaks in DNA in vitro and in vivo, also in eukaryotic cells. It is part of an RNA-mediated adaptive defence system known as Clustered Regularly Interspaced Short Palindromic Repeats (CRISPR) in bacteria and archaea. Cas9 gets sequence-specificity when it associates with a guide RNA molecule, which can target sequences present in an organism's DNA based on their sequence. Cas9 requires the presence of a Protospacer Adjacent Motif (PAM) immediately following the DNA sequence that is targeted by the guide RNA. The Cas9 enzyme has been first isolated from *Streptococcus pyogenes* (SpCas9), but functional homologues from many other bacterial species have been reported, such as *Neisseria meningitides, Treponema denticola, Streptococcus thermophilus, Francisella novicida, Staphylococcus aureus*, etcetera. For SpCas9, the PAM sequence is 5'-NGG-3', whereas various Cas9 proteins from other bacteria have been shown to recognise different PAM sequences. In nature, the guide RNA is a duplex between crRNA and tracrRNA, but a single guide RNA (sgRNA) molecule which may comprise both crRNA and tracrRNA has been shown to work equally well (Jinek et al, 2012, *Science* 337: 816-821). The advantage of using an sgRNA is that it reduces the complexity of the CRISPR-Cas9 system down to two components, instead of three. For use in an experimental setup (in vitro or in vivo) this is an important simplification.

An alternative for Cas9 is, for example, Cpf1, which does not need a tracrRNA to function, which recognises a different PAM sequence, and which creates sticky end cuts in the DNA, whereas Cas9 creates blunt ends.

On the one hand, genetic modification techniques can be applied to express a site-specific nuclease, such as an RNA-guided endonuclease and/or guide RNAs, in eukaryotic cells. One or more DNA constructs encoding an RNA-guided endonuclease and at least one guide RNA can be introduced into a cell or organism by means of stable transformation (wherein the DNA construct is integrated into the genome) or by means of transient expression (wherein the DNA construct is not integrated into the genome, but it expresses an RNA-guided endonuclease and at least one guide RNA in a transient manner). This approach requires the use of a transformation vector and a suitable promoter for expression in said cell or organism. Organisms into which foreign DNA has been introduced are considered to be Genetically Modified Organisms (GMOs), and the same applies to cells derived therefrom and to offspring of these organisms. In important parts of the worldwide food market, transgenic food is not allowed for human consumption, and not appreciated by the public. There is however also an alternative, "DNA-free" delivery method of CRISPR-Cas components into intact plants, that does not involve the introduction of DNA constructs into the cell or organism.

For example, introducing the mRNA encoding Cas9 into a cell or organism has been described, after in vitro transcription of said mRNA from a DNA construct encoding an RNA-guided endonuclease, together with at least one guide RNA. This approach does not require the use of a transformation vector and a suitable promoter for expression in said cell or organism.

Another known approach is the in vitro assembly of ribonucleoprotein (RNP) complexes, which may comprise an RNA-guided endonuclease protein (for example Cas9) and at least one guide RNA, and subsequently introducing the RNP complex into a cell or organism. In animals and animal cell and tissue cultures, RNP complexes have been introduced by means of, for example, injection, electroporation, nanoparticles, vesicles, and with the help of cell-penetrating peptides. In plants, the use of RNPs has been demonstrated in protoplasts, for example with polyethylene glycol (PEG) transfection (Woo et al, 2015, *Nat. Biotech.* 33: 1162-1164). After said modification of a genomic sequence has taken place, the protoplasts or cells can be used to produce plants that harbour said modification in their genome, using any plant regeneration method known in the art (such as in vitro tissue culture).

Breaking DNA using site specific nucleases, such as, for example, those described herein above, can increase the rate of homologous recombination in the region of the breakage. Thus, coupling of such effectors as described above with nucleases enables the generation of targeted changes in genomes which include additions, deletions and other modifications.

In one embodiment, the expression of an endogenous or native WOLF allele is eliminated in a spinach plant by the replacement of the endogenous or native WOLF allele or part thereof with a polynucleotide encoding a modified WOLF protein or part thereof, through a method involving homologous recombination as described above. In such an embodiment, the method may further comprise selfing a heterozygous plant which may comprise one copy of the new polynucleotide and one copy of the endogenous or native WOLF allele and selecting for a progeny plant that is homozygous for the new polynucleotide.

In one embodiment, the endogenous WOLF allele is thus replaced by a heterologous and/or modified WOLF allele. Suitably, replacing an endogenous WOLF allele by a heterologous and/or modified WOLF allele can be done in vitro (for example in protoplasts, cell or tissue culture) or in planta.

In a preferred embodiment, the sequence encoding the LRR domain of the WOLF protein is modified or replaced. In the research leading to the present invention, it has been found that resistance to *Peronospora farinosa* f. sp. *spinaciae* is largely determined by the sequence of the LRR domain of the WOLF protein. In particular, it seems from the current research results that the presence of an alpha-type LRR domain in the WOLF protein of a spinach plant is linked to a broader resistance profile, i.e. resistance to more pathogenic races of *Peronospora farinosa* f. sp. *spinaciae* in said spinach plant and/or an enhanced resistance profile, i.e. a profile in which the resistance to one or more races changes from intermediately resistant to resistant.

In a preferred embodiment, the sequence encoding the LRR domain of an endogenous WOLF protein is thus modified in such a manner, that it more closely resembles an alpha-type LRR domain. Alternatively, additional copies of alpha-type WOLF genes may be introduced. Table 3 shows the sequences of alpha-type LRR domains. These sequences can be used as an example of how to modify the endogenous gene.

For the purpose of this invention, the sequence encoding the LRR-domain of a WOLF protein is defined as the genomic region that can be amplified from the genome of a spinach plant by means of Polymerase Chain Reaction (PCR), using specific primer pairs. The sequence encoding an alpha-type LRR-domain (i.e. a sequence encoding the LRR-domain of an alpha-type WOLF protein) is defined as the genomic region that can be amplified using a primer pair wherein the forward primer is a nucleic acid molecule which may comprise the sequence of SEQ ID NO:1 and the reverse primer is a nucleic acid molecule which may comprise the sequence of SEQ ID NO:2. The sequence encoding a beta-type LRR-domain (i.e. a sequence encoding the LRR-domain of a beta-type WOLF protein) is defined as the genomic region that can be amplified using a primer pair wherein the forward primer is a nucleic acid molecule which may comprise the sequence of SEQ ID NO:3 and the reverse primer is a nucleic acid molecule which may comprise the sequence of SEQ ID NO:2.

PCR conditions for amplifying the LRR domain-encoding region of an alpha—WOLF gene using primers having SEQ ID NO:1 and SEQ ID NO:2 are, using Platinum Taq enzyme (Thermo Fisher Scientific): 3 minutes at 95° C. (initial denaturing step); 40 amplification cycles, each cycle consisting of: 30 seconds denaturation at 95° C., 30 seconds annealing at 60° C., and 30 seconds extension at 72° C.; 2 minutes at 72° C. (final extension step).

PCR conditions for amplifying the LRR domain-encoding region of a beta—WOLF gene using primers having SEQ ID NO:3 and SEQ ID NO:2 are as follows, using Platinum Taq enzyme (Thermo Fisher Scientific):—3 minutes at 95° C. (initial denaturing step); 40 amplification cycles, each cycle consisting of: 30 seconds denaturation at 95° C., 50 seconds annealing at 58° C. and 50 seconds extension at 72° C.; 2 minutes at 72° C. (final extension step).

This modification of an LRR-domain may be done in vitro, prior to making a construct for expression in a plant. For example, recombinant DNA technology may be used to operably fuse the sequence encoding an alpha-type LRR domain from one WOLF protein to a sequence encoding the N-terminal part of another WOLF protein, such that the expression construct encodes a chimeric protein that may comprise an N-terminal part from a first WOLF protein, fused to a C-terminal part of a second WOLF protein, wherein the C-terminal part may comprise an alpha-type LRR domain that is normally present in said second WOLF protein. The same can be done with a desirable beta-type domain.

Alternatively, said modification may be done in planta, using genome editing techniques. This is for example possible using techniques for in vivo sequence replacement such as the CRISPR-Cas system, as described above, wherein double-strand breaks are induced at the 5' end and at the 3' end of the sequence encoding the LRR-domain, and the endogenous sequence is replaced by an orthologous or modified sequence encoding an LRR-domain with a different sequence as the LRR-domain of the endogenous WOLF protein.

The method of the present invention leads to modification of the resistance profile of a spinach plant to *Peronospora farinosa* f. sp. *spinaciae*. "Resistance" is intended to mean that a plant does not develop the disease symptoms that are typically the outcome of the interaction between a spinach plant and the *Peronospora farinosa* f. sp. *spinaciae* pathogen, i.e. it avoids the development of yellow spots on its leaves and/or prevents the growth of the oomycete. In other words, the pathogen is prevented from causing a disease and the disease symptoms associated therewith in the plant, or the disease symptoms caused by the pathogen are minimised or lessened when compared to a control plant that is susceptible to said pathogen. "Resistance profile" is intended to mean the response of a spinach plant to different pathogenic races and isolates of *Peronospora farinosa* f. sp. *spinaciae*. Therefore, "resistance profile" refers to the combination of races of *Peronospora farinosa* f. sp. *spinaciae* to which a spinach plant shows resistance.

The resistance profile of a spinach plant may comprise scores for the interaction between said spinach plant and various pathogenic races and isolates of *Peronospora farinosa* f. sp. *spinaciae*. Three scores are possible: the plant is either resistant, intermediately resistant, or susceptible to a pathogenic race or isolate, and these scores are determined based on symptoms of chlorosis and signs of pathogen sporulation on the cotyledons and true leaves, as described in Example 1. An example of the resistance profiles of several reference spinach varieties is presented in Table 1.

"Modification of the resistance profile" is intended to mean that the resistance profile of a spinach plant is changed, compared to its original resistance profile. Preferably, this change corresponds to a broadening of the resistance profile, which means that the spinach plant becomes resistant to additional pathogenic races or isolates, and/or to an enhancement of the resistance profile, which means that the spinach plant becomes more resistant to the pathogenic races or isolates that it was already partially resistant to. However, this change may also correspond to a narrowing of the resistance profile, if this would be desirable in a certain situation.

In a preferred embodiment, said modification of the resistance profile leads to a resistance of a spinach plant to all pathogenic races of *Peronospora farinosa* f. sp. *spinaciae*, or to a majority of all known pathogenic races. Suitably, said modification of the resistance profile leads to a resistance of a spinach plant to pathogenic races Pfs1 and/or Pfs2 and/or Pfs3 and/or Pfs4 and/or Pfs5 and/or Pfs6 and/or Pfs7 and/or Pfs8 and/or Pfs9 and/or Pfs10 and/or Pfs11 and/or Pfs12 and/or Pfs13 and/or Pfs14 and/or Pfs15 and/or Pfs16 of *Peronospora farinosa* f. sp. *spinaciae*, and/or to pathogenic isolate US1508 of *Peronospora farinosa* f. sp. *spinaciae*. In a preferred embodiment, modification of the resistance profile leads to resistance against, in order of increase preference two, three, four, five, six, seven, eight, nine, ten, eleven, twelve, thirteen, fourteen, fifteen or all sixteen of the races Pfs1, Pfs2, Pfs3, Pfs4, Pfs5, Pfs6, Pfs7, Pfs8, Pfs9, Pfs10, Pfs11, Pfs12, Pfs13, Pfs14, Pfs15 and Pfs16 and optionally isolate US1508.

Modification of the resistance profile of a spinach plant to *Peronospora farinosa* f. sp. *spinaciae* may be determined through comparison of a plant obtainable by the method of the invention on the one hand to a suitable control plant on the other hand, using standardised infection tests with the various pathogenic races or isolates of *Peronospora farinosa* f. sp. *spinaciae*. Positive and negative control plants can be defined for each of the pathogenic races or isolates. An officially recognised differential set is publicly available, which may comprise a series of spinach cultivars (hybrids) that have different resistance profiles to the currently identified pathogenic races. This approach is, for example, described in Feng et al., 2014 (*Plant Dis*. 98: 145-152), and in Table 1 an overview in given of commonly used reference plants. The various plants of this differential set can be used as positive controls, as they have resistance to various combinations of the officially recognised pathogenic races, and their response to each pathogenic race is well-known.

The present invention also relates to a spinach plant which may comprise a WOLF allele, in particular a non-endogenous WOLF allele, obtainable by introducing a WOLF allele into the genome of the spinach plant, or by modifying an endogenous WOLF gene in the genome of the spinach plant. A spinach plant according to the invention is resistant to at least one pathogenic race or isolate of *Peronospora farinosa* f. sp. *spinaciae*. In a preferred embodiment, the invention relates to a spinach plant that has a modified resistance profile to *Peronospora farinosa* f. sp. *spinaciae* as compared to an isogenic spinach plant that has not been modified by the method of the invention. A spinach plant of the invention preferably may comprise a "non-endogenous" WOLF allele, which means that it has acquired a further WOLF allele and/or has a modified endogenous WOLF allele. The acquisition of the further allele and the modification of the endogenous allele are as compared to plant before undergoing the method of the invention, i.e. the starting plant. Of course, a plant of the invention can have acquired more than one additional WOLF allele and/or have more than one modified WOLF allele.

Two plants are considered "isogenic" when they have an identical genetic composition, apart from the presence or absence of a small number of defined genes or transgenes in one of them.

A negative control plant should be genetically identical or nearly identical to the transgenic spinach plant of the invention, and it should be exposed to the same environmental conditions and pathogen(s), but should not comprise the WOLF allele in its genome and not comprise the modified endogenous WOLF allele in its genome.

For example, in embodiments of the method of the invention for producing a spinach plant that is stably transformed with a nucleic acid construct which may comprise a coding region encoding one or more WOLF polypeptides, a control plant is preferably a spinach plant that is genetically identical to said transformed plant of the invention, except that the control plant lacks the nucleic acid construct of the invention or it contains a control construct that is designed to be non-functional with respect to modifying the resistance profile to *Peronospora farinosa* f. sp. *spinaciae*. Such a control construct may, for example, lack a promoter and/or a coding region, or may comprise a coding region that is unrelated to the WOLF allele of the invention. The control construct may, for example, be an "empty" vector, which lacks a nucleic acid insert in the site that is intended for foreign gene introduction. Alternatively, the control construct may for example comprise the WOLF allele of the variety Viroflay, which has been shown not to confer *Peronospora farinosa* f. sp. *spinaciae* resistance to a spinach plant. The genomic sequence of this gene corresponds to SEQ ID NO:4.

As used herein, the term "transgenic" refers to a plant into whose genome nucleic acid sequences have been incorporated, including but not limited to genes, polynucleotides, DNA sequences. These genes, polynucleotides, DNA sequences may occur naturally in a species, or they may be modified versions that are altered by human intervention, for example by means of mutagenesis (random or targeted) or gene editing. In contrast, a "non-transgenic plant" is a plant that does not have foreign or exogenous nucleic acid sequences incorporated into its genome by recombinant DNA methods.

A spinach plant which may comprise an additional and/or modified WOLF allele, obtainable by the method of the present invention, may comprise any allele that encodes a CC-NBS-LRR protein that may comprise in its amino acid sequence the motif "MAEIGYSVC" (SEQ ID NO:171) at its N-terminus, and the motif "KWMCLR" (SEQ ID NO:172) or "HVGCVVDR" (SEQ ID NO:173). Suitably, the WOLF allele can be selected from the nucleotide sequences listed in Table 3, or the WOLF protein has a sequence similarity of 95%, 96%, 97%, 98%, or 99% with any one of the amino acid sequences mentioned therein.

According to the invention, the gene sequence of various alleles of WOLF genes was determined. These gene sequences were not previously disclosed and are therefore also part of the invention. The invention thus further relates to a WOLF allele which may comprise a genomic sequence selected from SEQ ID NO:8, SEQ ID NO:12, SEQ ID NO:16, SEQ ID NO:20, SEQ ID NO:24, SEQ ID NO:28, SEQ ID NO:34, SEQ ID NO:38, SEQ ID NO:44, SEQ ID NO:50, SEQ ID NO:54, SEQ ID NO:60, SEQ ID NO:64, SEQ ID NO:72, SEQ ID NO:76, SEQ ID NO:82, SEQ ID NO:86, SEQ ID NO:90, SEQ ID NO:96, SEQ ID NO:102, SEQ ID NO:145, SEQ ID NO:155, or which may comprise a nucleotide sequence that encodes a WOLF protein having an amino acid sequence selected from SEQ ID NO:11, SEQ ID NO:15, SEQ ID NO:19, SEQ ID NO:23, SEQ ID NO:27, SEQ ID NO:32, SEQ ID NO:33, SEQ ID NO:37, SEQ ID NO:42, SEQ ID NO:43, SEQ ID NO:48, SEQ ID NO:49, SEQ ID NO:53, SEQ ID NO:58, SEQ ID NO:59, SEQ ID NO:63, SEQ ID NO:69, SEQ ID NO:70, SEQ ID NO:71, SEQ ID NO:75, SEQ ID NO:80, SEQ ID NO:81, SEQ ID NO:85, SEQ ID NO:89, SEQ ID NO:94, SEQ ID NO:95, SEQ ID NO:100, SEQ ID NO:101, SEQ ID NO:106, SEQ ID NO:107, SEQ ID NO:149, SEQ ID NO:150, SEQ ID NO:159, SEQ ID NO:160 or which may comprise a nucleotide sequence that encodes a protein that has a sequence similarity of 95%, 96%, 97%, 98%, or 99% with any one of these amino acid sequences. In a specific embodiment, said WOLF allele has been isolated from the genome of a spinach plant.

The invention also relates to a vector which may comprise a WOLF allele as defined above, and to a spinach plant which may comprise said vector.

The present invention also provides progeny of a spinach plant of the invention, wherein said progeny may comprise a non-endogenous resistance-conferring WOLF allele. "Progeny" encompasses plants that are sexual descendants (in any subsequent generation) from spinach plants of the invention, and plants that result from vegetative (asexual) propagation or multiplication of spinach plants of the invention. The progeny plants have retained the WOLF alleles of the invention, and the modified resistance profile.

The invention further provides propagation material of a spinach plant of the invention, which may be used to grow or regenerate a spinach plant that may comprise a resistance-conferring WOLF allele, in particular a non-endogenous WOLF allele, i.e. an additional WOLF allele and/or a modified WOLF allele. Preferably, a spinach plant grown or regenerated from the propagation material displays the same modified resistance profile to *Peronospora farinosa* f. sp. *spinaciae* as the plant from which said propagation material has been derived. In one embodiment, the propagation material is suitable for sexual reproduction. Such propagation material may comprise for example microspores, pollen, ovaries, ovules, embryo sacs and egg cells. In another embodiment, the propagation material is suitable for vegetative reproduction. Such propagation material may comprise for example cuttings, roots, stems, cells, protoplasts, and tissue cultures of regenerable cells, parts of the plant that are suitable for preparing tissue cultures, in particular leaves, pollen, embryos, cotyledons, hypocotyls, meristematic cells, root tips, anthers, flowers, seeds and stems. The invention further relates to a spinach plant grown or regenerated from said propagation material, which plant may comprise a resistance-conferring WOLF allele and preferably has a modified resistance profile to *Peronospora farinosa* f. sp. *spinaciae*.

The invention also relates to a cell of a spinach plant of the invention, which cell may comprise a non-endogenous WOLF allele i.e. an additional WOLF allele and/or a modified WOLF allele. Preferably, the cell of the invention is part of a plant or plant part, but the cell may also be in isolated form.

The invention further relates to a seed capable of growing into a spinach plant of the invention, which seed contains in its genome a non-endogenous WOLF allele, in particular an additional WOLF allele and/or a modified WOLF allele that results in a modified resistance profile in the plant as compared to a plant not which may comprise the additional and/or modified WOLF allele.

The invention also relates to all commercial products that can be derived from spinach plants of the invention, such as harvested leaves of a spinach plant of the invention, a food product which may comprise the harvested leaves of a spinach plant of the invention. The invention also relates to a container which may comprise one or more spinach plants of the invention in a growth substrate for harvest of leaves from the spinach plant in a domestic environment. The downy mildew resistance is not just relevant in the growth stage of the plant to become a harvestable product but also after harvest to protect the commercial product from acquiring symptoms.

The invention also relates to a method for selecting a spinach plant which may comprise a novel WOLF allele that confers resistance to *Peronospora farinosa* f. sp. *spinaciae* in a spinach plant, which may comprise:

a) determining the sequence of at least part of a WOLF allele in the genome of a spinach plant;

b) comparing said sequence to the sequences of previously identified WOLF genes, in particular the sequences in Table 3;

c) if the sequence is substantially different from any of the sequences of previously identified WOLF genes, in particular any of the sequences in Table 3, select the spinach plant that harbours said sequence in its genome as a spinach plant that may comprise a novel WOLF gene.

In case the sequence determined in step a) is a genomic sequence comparison should be made with the genomic sequences of known alleles, in particular the alleles listed in Table 3. Likewise, when the determined sequence is a cDNA the cDNA of the known alleles should be used in the comparison.

The purpose of this method is to identify individuals that harbour in their genome a previously unknown resistance allele that, upon introduction into the genome of a spinach plant, modifies the resistance profile of said spinach plant to *Peronospora farinosa* f. sp. *spinaciae*. Preferably, said pathogenic races also include the pathogenic races that have been most recently identified, and also the pathogenic races that will be identified in the future.

In the state-of-the-art approach for resistance breeding in spinach, a collection of spinach plants is usually screened, in the hope that a source of resistance to newly identified isolates of *Peronospora farinosa* f. sp. *spinaciae* can be identified therein. This screening is performed at the level of the resistance phenotype, i.e. many different plants are inoculated with spores of the new pathogenic isolate, and the breeder checks which spinach germplasm displays a level of resistance to the new isolate. Said collection of spinach plants may comprise, for example, commercial spinach varieties, publicly available spinach breeding material, a company's private spinach breeding material, spinach gene bank material, wild spinach plants, and wild relatives of cultivated *Spinacia oleracea*. Wild relatives of cultivated spinach are, for example, *Spinacia tetrandra* and *Spinacia turkestanica*. If resistance to the pathogenic race is encountered in a spinach plant of the collection, this plant may be used in breeding. However, this is only possible if the resistance has a genetic basis, and if the resistant plant can be conveniently crossed to elite breeding lines of *Spinacia oleracea*. This phenotypic screening approach is thus very labour-intensive, and a positive outcome is not guaranteed due to a number of possible technical complications.

The method of the present invention bypasses the need for large-scale phenotypical screening, and thus it speeds up the identification and selection of potential resistance sources for existing and new isolates of *Peronospora farinosa* f. sp. *spinaciae*. In the research leading to the present invention, it was observed that all sources of resistance to known isolates of *Peronospora farinosa* f. sp. *spinaciae* are alleles (or combination of alleles) of the same locus in the spinach genome. These WOLF alleles, as defined in the current application, lie at the basis of resistance to a broad range of pathogenic races of *Peronospora farinosa* f. sp. *spinaciae*.

In a first step of this selection method, the sequence of at least part of a WOLF allele is determined in the genome of a spinach plant.

In a second step of the selection method, the sequence of at least part of a WOLF allele that has been determined in the genome of a spinach plant is compared to the sequence of other WOLF alleles. Preferably, this comparison is done at the level of the encoded amino acid sequence since nucleotide changes may not result in amino acid changes. Comparing at the protein level is thus more likely to result in identification of novel WOLF alleles with a new resistance profile.

The third step of the selection method involves selection of a spinach plant that harbours in its genome a WOLF allele sequence that is substantially different from the sequences in Table 3. Said plant can then be selected as a spinach plant that may comprise a novel WOLF allele. The three steps of this selection method will be discussed in more detail below.

Determining the sequence of at least part of a WOLF allele in the genome of a spinach plant may be performed using any suitable molecular biological method known in the art, including but not limited to (genomic) PCR amplification followed by sequencing, whole-genome-sequencing, transcriptome-sequencing, sequence-specific target capture followed by next-generation sequencing (using, for example, the xGen© target capture system of Integrated DNA Technologies), specific amplification of LRR-domain-which may comprise gene sequences (using, for example, the RenSeq methodology, as described in U.S. patent application Ser. No. 14/627,116, and in Jupe et al., 2013, *Plant J.* 76: 530-544) followed by sequencing, etcetera.

Suitably, the step of specifically amplifying at least part of a WOLF allele from the genome of a spinach plant may be performed by means of PCR, using the following primer pairs, as is further illustrated in Example 2: forward primer ACAAGTGGATGTGTCTTAGG (SEQ ID NO:1) and reverse primer TTCGCCCTCATCTTCCTGG (SEQ ID NO:2) for the identification of alpha-type WOLF alleles, and forward primer TCACGTGGGTTGTGTTGT (SEQ ID NO:3) and reverse primer TTCGCCCTCATCTTCCTGG (SEQ ID NO:2) for the identification of beta-type WOLF alleles.

Determining the sequence of DNA may be performed using any suitable molecular biological method known in the art, including but not limited to Sanger sequencing of the PCR fragment (with or without a cloning step into a suitable vector), next-generation sequencing of the PCR fragment or of pools of the PCR fragments from different spinach plants (for example making use of molecular barcodes to allow the unambiguous identification of the plant from which each individual sequence has been obtained), etcetera.

As mentioned above, different primer pairs have been designed for the specific amplification of part of alpha- and beta-type WOLF alleles from a spinach genome. One PCR reaction may thus yield an amplified fragment for one or more alpha-type WOLF alleles, and another PCR reaction may yield an amplified fragment for one or more beta-type WOLF alleles. If a spinach plant harbours in its genome more than one copy of an alpha- and/or a beta-type WOLF allele, more than one amplicon will be obtained. In such a situation, direct Sanger sequencing of the PCR reaction products is not recommended, and subcloning of the PCR fragments in a suitable vector is advisable prior to sequencing of the PCR fragments. Alternatively, other approaches may be used to obtain reliable sequence information for each amplicon.

Once the DNA-sequence of at least part of the WOLF allele (or WOLF alleles) from an investigated spinach plant has been determined, said sequence is compared to the corresponding sequences of other WOLF alleles. Preferably, this comparison is done at the level of the encoded amino acid sequence. To be able to do this, the coding DNA-sequence of the WOLF allele or part thereof needs to be translated into the encoded amino acid sequence, thereby applying common sense in choosing the correct reading frame. The skilled person is capable of doing this, using freely available online bioinformatics tools such as can be found here: web.expasy.org/translate/

Comparing the sequence of a WOLF allele or part thereof can be done using standard bioinformatics tools for the alignment of sequences. Typically, this involves determining the percentage identity of two sequences. To determine the percentage identity of two nucleic acid sequences or of two amino acid sequences, the sequences are aligned for optimal comparison purposes. The "percent identity" between the two sequences is a function of the number of identical positions shared by the sequences (=number of identical positions/total number of positions×100). In one embodiment, the two sequences have an identical length. The percent identity between two sequences can be determined with or without allowing gaps in the sequences. In calculating percent identity, exact matches are counted. The determination of percent identity between two sequences can be done using a mathematical algorithm. A preferred but non-limiting example of a mathematical algorithm that is used for the comparison of two sequences is the algorithm of Karlin and Altschul 1990 (*Proc. Natl. Acad. Sci. USA* 87: 2264), modified as described in Karlin and Altschul 1993 (*Proc. Natl. Acad. Sci. USA* 90: 5873-5877). Such an algorithm is incorporated into the NBLAST and XBLAST programs of Altschul et al 1990 (*J. Mol. Biol.* 215: 403). BLAST nucleotide searches can be performed with the NBLAST program to obtain nucleotide sequences homologous to the polynucleotides of the invention. BLAST protein searches can be performed with the XBLAST program to obtain amino acid sequences homologous to protein molecules of the invention, for example on the website: www.ncbi.nlm.nih.gov. The default parameters can be used for this purpose.

Sequence identity or sequence similarity values provided herein refer to the value obtained using the full-length sequences of the invention (i.e. the full-length sequence of either a complete WOLF allele or WOLF protein, or of the LRR-domain-encoding part of a WOLF allele that can be amplified using the primer pairs referred to above, or of the LRR-domain encoded by said part of a WOLF allele) and using multiple alignment by means of the algorithm Clustal W (Larkin Mass. et al, 2007, *Bioinformatics* 23: 2947-2948) using default parameters, or similar analysis tools, which can for example be found on the website: www.ebi.ac.uk/Tools/psa.

In this manner it can be determined whether the amino acid sequence encoded by the one or more WOLF alleles that are present in the genome of an investigated spinach plant resembles that of any of the previously identified WOLF alleles, or whether they constitute novel WOLF alleles. Given the fact that sequence variation in the WOLF gene locus lies at the basis of the resistance profile of spinach plants to pathogenic races of *Peronospora farinosa* f. sp. *spinaciae*, as has been found in the research leading to the present invention, all new alleles of a WOLF gene are potentially interesting for breeding purposes. The outcome of this query will be one of two options: either the sequence of the one or more WOLF alleles in the investigated spinach plant is identical or substantially identical to that of a previously identified WOLF allele, or it is substantially different.

When performing step a) of the selection method using the primer pairs disclosed above, the sequence encoding the LRR domain of a WOLF allele is obtained. Said primer pairs amplify the LRR domain-encoding region of a WOLF allele, and they have been designed for selectively amplifying part of a WOLF allele, and not of other CC-NBS-LRR protein-encoding alleles. In the spinach genome, these primers are thus specific for the WOLF locus. Furthermore, these primer pairs amplify a region of a WOLF allele that allows a clear discrimination between all WOLF alleles that have been identified in the research leading to the current invention. In other words, the amplified fragments can be used to determine whether the WOLF allele that is present in the investigated spinach plant is identical or substantially identical to previously identified WOLF alleles, or whether it represents a WOLF allele that is substantially different from all previously identified WOLF alleles.

When the compared sequence is identical or substantially identical to that of a previously identified WOLF allele, the resistance profile that is conferred by said WOLF allele is expected to be identical to that conferred by the previously identified WOLF allele with the same sequence. In other words: said WOLF alleles likely confer the same resistance profile onto a spinach plant, i.e. they give resistance to the same combination of pathogenic races.

"Substantially identical" is here intended to mean that the sequence of the identified WOLF allele or part thereof is nearly identical to the sequence of a previously identified WOLF allele or part thereof, apart from one or more silent mutations (i.e. mutations that do not result in an amino acid change in the encoded WOLF protein) and/or one or more conservative amino acid replacements (i.e. mutations that result in a conservative amino acid change in the encoded WOLF protein, for example the replacement of one hydrophobic, non-polar amino acid such as such as Ala, Val, Leu, Ile, Pro, Phe, Trp or Met by another hydrophobic, non-polar amino acid, or the replacement of one hydrophilic, polar amino acid such as Gly, Ser, Thr, Cys, Tyr, Asn or Gln by another hydrophilic, polar amino acid, or the replacement of one acidic, negatively charged amino acid such as Asp or Glu by another acidic, negatively charged amino acid, or the replacement of one basic, positively charged amino acid, such as Lys, Arg or His by another basic, positively charged amino acid.

"Substantially different" is here intended to mean that a WOLF allele or part thereof harbours in its encoded amino acid sequence at least one non-conservative amino acid replacement, and/or at least one insertion or deletion that changes the amino acid sequence of the encoded WOLF protein. Said insertion or deletion may, for example, cause the insertion or deletion of one or more amino acids in the encoded WOLF protein sequence, as compared to the encoded protein sequence of a previously identified WOLF allele, or it may cause a frame-shift in the encoding sequence, leading to a premature stop-codon (which leads to the expression of a truncated version of the encoded WOLF protein) and/or to a change in the encoded amino acid sequence downstream from the location of the frame shift, as compared to the encoded protein sequence of a previously identified WOLF allele.

When a spinach plant harbours in its genome a WOLF allele that encodes a WOLF protein with a sequence that is substantially different from all previously identified WOLF proteins, said spinach plant is potentially interesting for resistance breeding. The resistance profile that is conferred onto a spinach plant by a WOLF protein with a different sequence than all previously identified WOLF proteins is initially unknown, and this can subsequently be investigated. The large sequence variation at the WOLF gene locus that is present in the collection of available spinach germplasm allows a selection of spinach plants that harbour in their genome one or more WOLF alleles that may confer a novel resistance profile to pathogenic races of *Peronospora farinosa* f. sp. *spinaciae*.

An exception, however, are WOLF alleles that have a premature stop-codon and/or a frame-shift in their coding sequence, especially when this stop-codon and/or frame-shift affects the LRR-domain or the amino acid sequences at the N-terminal side of the LRR-domain. Spinach plants which may comprise such a WOLF allele are unlikely to be useful for resistance breeding, because they do not express a functional WOLF protein, unless they have another WOLF allele in their genome that is functional. Such non-functional WOLF alleles are not part of the invention.

When a novel WOLF allele is found in the genome of a hybrid plant, said plant will need to be inbred before it becomes possible to determine the functionality of said novel WOLF gene, because in a heterozygous state the presence of potentially other WOLF alleles may interfere with this functional assessment.

In this application reference is made to "previously identified WOLF alleles" to distinguish between alleles that were identified by the present inventors in prior art plants and of which the sequence at the nucleotide and/or amino acid level was already determined by them and disclosed herein, and alleles of which the sequence was not yet determined. It should be noted that the list of "previously identified WOLF alleles" is non-exhaustive, as it continues to expand while applying the identification method of the present invention. In the course of applying this screening method, different WOLF allele sequences are obtained from different germplasm, and these sequences can then be added to the list. In the research leading to the present invention, a number of representative examples of WOLF allele have thus been sequenced, and their sequences can be found in this application, and they are further illustrated in Examples 2 and 3. In one embodiment, the WOLF alleles are selected from the sequences in Table 3.

The third step of the selection method involves selection of a spinach plant that harbours in its genome a WOLF sequence that is substantially different from the sequences of previously known WOLF alleles. In one embodiment, "previously known WOLF alleles" are selected from the sequences in Table 3. Said plant can then be selected as a spinach plant that may comprise a novel WOLF allele. The selection need not necessarily be an active step. Once the comparison is made sequences that are found to be different from the known sequences are inherently selected.

When a spinach plant has been selected that harbours in its genome one or more WOLF alleles that are substantially different from all known WOLF alleles, said spinach plant may be used in breeding for modifying the resistance profile of spinach to Peronospora farinosa f. sp. spinaciae. It should then first be determined whether said spinach plant is resistant to any of the known pathogenic races or pathogenic isolates of Peronospora farinosa f. sp. spinaciae that are known to date. To determine this, a resistance assay can be performed, for example as described in Example 1. The outcome of this assay will then determine the usefulness of said spinach plant for breeding. If the selected spinach plant does not display resistance to any of the isolates or pathogenic races, it is not immediately suitable to be used in resistance breeding. Nevertheless, it can be retained as a potential source of resistance to any pathogenic isolates that may be encountered in the future, and for which a resistance in spinach would then become desirable.

If the selected spinach plant displays resistance to a subset of the tested isolates or pathogenic races, it may be interesting for immediate use in resistance breeding. It may, for example, be combined with other spinach plants that display a different (suitably a complementary) resistance profile, in order to confer upon the progeny of such a cross a broader resistance profile that is—in the ideal case—the sum of both parental resistance profiles. If the selected spinach plant displays resistance to all tested isolates or pathogenic races, or to a broad range of the tested isolates or pathogenic races, and/or to pathogenic isolates for which no source of resistance had previously been identified, then it is highly relevant for resistance breeding.

The spinach plants that are selected with the method of the present invention are maintained as a resource of potential resistance genes, on which any new pathogenic isolate of Peronospora farinosa f. sp. spinaciae that is encountered in the future can be tested. It is quite possible that WOLF alleles are present in the genome of the set of selected spinach plants, that can confer resistance to any new pathogenic variant of Peronospora farinosa f. sp. spinaciae that will evolve in the future. Such a set of spinach plants collectively harbouring in their genomes a large diversity of WOLF alleles is thus an invaluable tool for resistance breeding in spinach.

The complete sequence of a WOLF allele can be determined after its presence has been detected in a spinach plant. This may be done, for example, by means of 5' and 3' RACE, complete genome sequencing, sequence-specific capture followed by sequencing, etcetera. This approach may be desired, for example, when planning transgenic experiments, such as the one outlined in Example 3.

The selection method of the invention may be performed in a high-throughput setup, and it may suitably be applied to single plants, but also (either simultaneously or sequentially) to dozens, hundreds or thousands of genetically distinct spinach plants. The screened material may e.g. comprise commercial spinach varieties, publicly available spinach breeding material, a company's private spinach breeding material, spinach gene bank material, wild spinach plants, and wild relatives of cultivated Spinacia oleracea. Wild relatives of cultivated spinach are, for example, Spinacia tetrandra and Spinacia turkestanica.

The present invention also relates to a method for identifying a WOLF allele that confers resistance to one or more pathogenic races of Peronospora farinosa f. sp. spinaciae in a spinach plant, which may comprise:
a) phenotypically selecting a spinach plant that is resistant to one or more pathogenic races of Peronospora farinosa f. sp. spinaciae;
b) determining the sequence of at least part of a WOLF allele that is present in the genome of said spinach plant, and
c) optionally comparing the sequence to a reference sequence representing the WOLF allele to be identified.

In other words, said method is a method for the rapid identification of the allele that is responsible for a phenotypically observed resistance profile to pathogenic races or isolates of Peronospora farinosa f. sp. spinaciae. When a new pathogenic isolate has been identified, it is typically tested on a differential set of spinach germplasm, for example the differential set as disclosed herein, and—if no suitable source of resistance to this pathogenic isolate is present therein—also on a larger set of spinach germplasm, such as gene bank material. If one of the tested spinach plants shows resistance to the new isolate, it would be interesting to be able to quickly identify the sequence that confers said resistance. The teachings of the present disclosure enable this rapid identification of the causal allele.

Therefore, the invention also relates to newly identified alleles of the alpha- and beta-WOLF genes. In one embodiment such an allele is an allele of an alpha-WOLF gene, wherein the protein encoded by said allele is a CC-NBS-LRR protein that may comprise in its amino acid sequence: a) the motif "MAEIGYSVC" (SEQ ID NO:171) at its N-terminus; and b) the motif "KWMCLR" (SEQ ID NO:172); and wherein the LRR domain of the protein has in order of increased preference 50%, 55%, 60%, 65%, 70%, 75%, 80%, 82%, 85%, 87%, 90%, 91%, 92%, 93%, 94%, 95%, 96%, 97%, 98%, 99%, sequence similarity to any one of the amino acid sequences having SEQ ID NO:111. SEQ ID NO:113, SEQ ID NO:117, SEQ ID NO:118, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:139, SEQ ID NO:152, SEQ ID NO:154, SEQ ID NO:162, SEQ ID NO:164, SEQ ID NO:166, SEQ ID NO:168, SEQ ID NO: 170.

The invention also relates to a spinach plant, preferably an agronomically elite spinach plant which may comprise an allele of an alpha-WOLF gene, wherein the protein encoded by said allele is a CC-NBS-LRR protein that may comprise in its amino acid sequence: a) the motif "MAEIGYSVC" (SEQ ID NO: 171) at its N-terminus; and b) the motif "KWMCLR" (SEQ ID NO:172); and wherein the LRR domain of the protein has in order of increased preference 50%, 55%, 60%, 65%, 70%, 75%, 80%, 82%, 85%, 87%, 90%, 91%, 92%, 93%, 94%, 95%, 96%, 97%, 98%, 99%, sequence similarity to any one of the amino acid sequences having SEQ ID NO:111. SEQ ID NO:113, SEQ ID NO:117, SEQ ID NO:118, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:139, SEQ ID NO:152, SEQ ID NO: 154, SEQ ID NO:162, SEQ ID NO:164, SEQ ID NO:166, SEQ ID NO:168, SEQ ID NO:170.

In another embodiment, such a newly identified allele is an allele of a beta-WOLF gene, wherein the protein encoded by said allele is a CC-NBS-LRR protein that may comprise in its amino acid sequence: a) the motif "MAEIGYSVC" (SEQ ID NO:171) at its N-terminus; and b) the motif "HVGCVVDR" (SEQ ID NO:173); and wherein the LRR domain of the protein has in order of increased preference 50%, 55%, 60%, 65%, 70%, 75%, 80%, 82%, 85%, 87%, 90%, 91%, 92%, 93%, 94%, 95%, 96%, 97%, 98%, 99%, sequence similarity to any one of the amino acid sequences having SEQ ID NO:109, SEQ ID NO:115 SEQ ID NO:137.

The invention also relates to a spinach plant, preferably an agronomically elite spinach plant which may comprise an allele of a beta-WOLF gene, wherein the protein encoded by said allele is a CC-NBS-LRR protein that may comprise in its amino acid sequence: a) the motif "MAEIGYSVC" (SEQ ID NO:171) at its N-terminus; and b) the motif "HVGCVVDR" (SEQ ID NO:173); and wherein the LRR domain of the protein has in order of increased preference 50%, 55%, 60%, 65%, 70%, 75%, 80%, 82%, 85%, 87%, 90%, 91%, 92%, 93%, 94%, 95%, 96%, 97%, 98%, 99%, sequence similarity to any one of the amino acid sequences having SEQ ID NO:109, SEQ ID NO:115, SEQ ID NO:137.

The invention further relates to a spinach plant which may comprise a WOLF allele wherein the WOLF allele encodes a CC-NBS-LRR protein that may comprise in its amino acid sequence:

the motif "MAEIGYSVC" (SEQ ID NO:171) at its N-terminus, and wherein the LRR domain of the WOLF allele has an amino acid sequence selected from the group consisting of SEQ ID NO:109, SEQ ID NO:111. SEQ ID NO:113, SEQ ID NO:115, SEQ ID NO:117, SEQ ID NO:118, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO: 152, SEQ ID NO:154, SEQ ID NO:162, SEQ ID NO:164, SEQ ID NO:166, SEQ ID NO:168, and SEQ ID NO:170.

In a further embodiment the invention relates to a hybrid spinach plant which may comprise two WOLF alleles, wherein the LRR domain of the first WOLF-allele and second WOLF-allele have an amino acid sequence selected from the group consisting of SEQ ID NO:109, SEQ ID NO:111. SEQ ID NO:113, SEQ ID NO:115, SEQ ID NO:117, SEQ ID NO:118, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO: 152, SEQ ID NO:154, SEQ ID NO:162, SEQ ID NO:164, SEQ ID NO:166, SEQ ID NO:168, and SEQ ID NO:170. The first and second WOLF-allele can be the same or different. The invention thus relates to any combination of two alleles wherein the LRR domain of the first WOLF-allele and second WOLF-allele have an amino acid sequence selected from the group consisting of SEQ ID NO:109, SEQ ID NO:111. SEQ ID NO:113, SEQ ID NO:115, SEQ ID NO:117, SEQ ID NO:118, SEQ ID NO: 119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO: 152, SEQ ID NO: 154, SEQ ID NO:162, SEQ ID NO:164, SEQ ID NO:166, SEQ ID NO:168, and SEQ ID NO:170.

Preferably the combination of WOLF alleles is such that the resistance profile covers as many races and isolates of *Peronospora farinosa* f. sp. *spinaciae* as possible.

In a specific embodiment the hybrid spinach plant which may comprise two WOLF alleles, wherein LRR domain of the first WOLF allele has an amino acid sequence corresponding to SEQ ID NO:125 and wherein the LRR domain of the second WOLF allele has an amino acid sequence corresponding to SEQ ID NO:164.

In a specific embodiment the hybrid spinach plant which may comprise two WOLF alleles, wherein LRR domain of the first WOLF allele has an amino acid sequence corresponding to SEQ ID NO:125 and wherein the LRR domain of the second WOLF allele has an amino acid sequence corresponding to SEQ ID NO:166.

In a specific embodiment the hybrid spinach plant which may comprise two WOLF alleles, wherein LRR domain of the first WOLF allele has an amino acid sequence corresponding to SEQ ID NO:127 and wherein the LRR domain of the second WOLF allele has an amino acid sequence corresponding to SEQ ID NO:164.

In a specific embodiment the hybrid spinach plant which may comprise two WOLF alleles, wherein LRR domain of the first WOLF allele has an amino acid sequence corresponding to SEQ ID NO:133 and wherein the LRR domain of the second WOLF allele has an amino acid sequence corresponding to SEQ ID NO:152.

In a specific embodiment the hybrid spinach plant which may comprise two WOLF alleles, wherein LRR domain of the first WOLF allele has an amino acid sequence corresponding to SEQ ID NO:135 and wherein the LRR domain of the second WOLF allele has an amino acid sequence corresponding to SEQ ID NO:164.

In a specific embodiment the hybrid spinach plant which may comprise two WOLF alleles, wherein LRR domain of the first WOLF allele has an amino acid sequence corresponding to SEQ ID NO:131 and wherein the LRR domain of the second WOLF allele has an amino acid sequence corresponding to SEQ ID NO:170.

In a specific embodiment the hybrid spinach plant which may comprise two WOLF alleles, wherein LRR domain of the first WOLF allele has an amino acid sequence corresponding to SEQ ID NO:133 and wherein the LRR domain of the second WOLF allele has an amino acid sequence corresponding to SEQ ID NO:170.

In a specific embodiment the hybrid spinach plant which may comprise two WOLF alleles, wherein LRR domain of the first WOLF allele has an amino acid sequence corresponding to SEQ ID NO:164 and wherein the LRR domain of the second WOLF allele has an amino acid sequence corresponding to SEQ ID NO:170.

In a further embodiment the plant of the invention which may comprise one or more WOLF alleles is an agronomically elite spinach plant.

In the context of this invention an agronomically elite spinach plant is a non-naturally occurring plant having a genotype that results into an accumulation of distinguishable and desirable agronomic traits which is the result of human intervention, and is e.g. achieved by crossing and selection, mutagenizing, transforming or otherwise introducing such traits. An agronomically elite spinach plant includes any cultivated *Spinacia oleracea* plant regardless of type, such as breeding lines (e.g. backcross lines, inbred lines), cultivars and varieties (open pollinated or hybrids). Plants of *Spinacia oleracea* occurring in the wild (i.e. not cultivated spinach) or wild relatives of *Spinacia oleracea*, such as *Spinacia tetrandra* and *Spinacia turkestanica*, are not encompassed by this definition.

Preferably, the agronomically elite spinach plant which may comprise the WOLF allele is a plant of an inbred line or a hybrid.

As used herein, a plant of an inbred line is a plant of a population of plants that is the result of three or more rounds of selfing, or backcrossing; or which plant is a double haploid. An inbred line may e.g. be a parent line used for the production of a commercial hybrid.

As used herein, a hybrid plant is a plant which is the result of a cross between two different plants having different genotypes. More in particular, a hybrid plant is the result of a cross between plants of two different inbred lines, such a hybrid plant may e.g. be a plant of an F1 hybrid variety.

In one embodiment, the invention relates to a method for identifying a WOLF allele that confers resistance to one or more pathogenic races of *Peronospora farinosa* f. sp. *spinaciae* in a spinach plant, wherein part of a WOLF allele is amplified from the plant's genome by means of PCR. Preferably, said part of a WOLF allele is the region encoding the LRR-domain of the encoded WOLF protein. The LRR-domain-encoding region can suitably be amplified by means of PCR, using a primer pair, wherein the forward primer is a nucleic acid molecule which may comprise the sequence of SEQ ID NO:1 or SEQ ID NO:3, and the reverse primer is a nucleic acid molecule which may comprise the sequence of SEQ ID NO:2.

The invention also relates to a primer pair for amplifying part of a WOLF allele from the genome of a spinach plant, wherein the forward primer is a nucleic acid molecule which may comprise the sequence of SEQ ID NO:1 or SEQ ID NO:3, and the reverse primer is a nucleic acid molecule which may comprise the sequence of SEQ ID NO:2. The use of said primer pair is illustrated in Example 2 and is also part of this invention.

The invention also relates to the use of a WOLF allele or part thereof as a marker in breeding or in producing a spinach plant that is resistant to *Peronospora farinosa* f. sp. *spinaciae*.

The teachings of the present disclosure greatly facilitate resistance breeding in spinach, because they identify genetic variation in the alpha and beta WOLF genes as the major source of enhanced resistance against *Peronospora farinosa* f. sp. *spinaciae*.

A gene is a section of DNA that controls a certain trait. An allele is one of a number of alternative forms of the same gene or same genetic locus. Different alleles may result in different observable phenotypic traits. Chromosomes occur in pairs so organisms have two alleles for each gene—one allele in each chromosome in the pair. This invention relates to two types of WOLF genes, alpha-type WOLF genes and beta-type WOLF genes. There are a number of alternative forms of the alpha-type WOLF genes and a number of alternative forms of the beta-type WOLF genes. Alpha-type WOLF alleles are variants of an alpha-type WOLF gene and beta-type WOLF alleles are variants of a beta-type WOLF gene. A plant that has two WOLF genes will have four WOLF alleles. A plant that has three WOLF genes has six WOLF alleles, etc. Within a gene, the alleles may be the same or different but are preferably different because that way two resistance profiles can be combined. As used in this application the term "allele" is thus used for one form of a WOLF gene. However, sometimes the word "gene" may be used where actually an allele is intended. It will be clear to the skilled person when that is the case.

Table 1 shows the differential set of spinach downy mildew races and the resistance of various spinach varieties (hybrids) to each one of these pathogenic races. A susceptible reaction is scored as "+" (indicating a successful infection by the fungus), and resistance is depicted as "−" (absence of sporulation on the cotyledons). A weak resistance response is indicated as "(−)", which in practice means a slightly reduced level of infection (with only symptoms of chlorosis, or sporulation only occurring on the tips of the cotyledons in the differential seedling test).

TABLE 1

| Races/plants | Viroflay | Resistoflay | Califlay | Clermont | Campania | Boeing | Lion | Lazio | Whale | Polka | Pigeon | Meerkat |
|---|---|---|---|---|---|---|---|---|---|---|---|---|
| Pfs:1 | + | − | − | − | − | − | − | − | − | − | − | − |
| Pfs:2 | + | + | + | − | − | − | − | − | − | − | − | − |
| Pfs:3 | + | + | − | − | − | − | − | − | − | − | − | − |
| Pfs:4 | + | + | + | − | − | − | − | − | (−) | + | − | − |
| Pfs:5 | + | + | − | + | − | − | − | − | − | − | − | − |
| Pfs:6 | + | + | + | + | + | − | − | − | (−) | + | − | − |
| Pfs:7 | + | + | + | + | − | − | − | − | (−) | + | − | − |
| Pfs:8 | + | + | − | + | + | + | − | − | − | − | − | − |
| Pfs:9 | + | + | − | + | + | − | − | − | − | − | − | − |
| Pfs:10 | + | + | + | + | + | + | + | − | + | + | − | − |
| Pfs:11 | + | + | − | + | − | − | − | + | − | − | − | − |
| Pfs:12 | + | + | − | + | + | + | − | + | − | − | − | − |
| Pfs:13 | + | + | + | + | (−) | − | − | + | + | (−) | − | − |
| Pfs:14 | + | + | − | + | + | + | − | + | (−) | − | + | − |
| Pfs:15 | + | + | + | − | − | − | − | − | + | + | − | − |
| US1508 | + | + | − | − | − | − | − | − | − | − | + | + |
| Pfs:16 | + | + | − | + | − | − | − | + | − | − | + | + |

TABLE 2

WOLF alleles identified and selected using the selection method of the invention

| Allele name | NCIMB deposit | LRR DNA SEQ ID NO: | LRR protein SEQ ID NO: |
|---|---|---|---|
| Beta WOLF 0 | NCIMB 42643 | 108 | 109 |
| Alpha WOLF 2 | NCIMB 42652 | 110 | 111 |
| Alpha WOLF 2a | NCIMB 42642 | 112 | 113 |
| Beta WOLF 3 | NCIMB 42652 | 114 | 115 |
| Alpha WOLF 4 | NCIMB 42655 | 116 | 117 |
| Alpha WOLF 4a | NCIMB 42645 | 118 | 119 |
| Alpha WOLF 6 | NCIMB 42654 | 120 | 121 |
| Alpha WOLF 6b | NCIMB 42648 | 122 | 123 |
| Alpha WOLF 7 | NCIMB 42653 | 124 | 125 |

TABLE 2-continued

WOLF alleles identified and selected using the selection method of the invention

| Allele name | NCIMB deposit | LRR DNA SEQ ID NO: | LRR protein SEQ ID NO: |
|---|---|---|---|
| Alpha WOLF 8 | NCIMB 42646 | 126 | 127 |
| Alpha WOLF 9 | NCIMB 42656 | 132 | 133 |
| Alpha WOLF 10 | NCIMB 42656 | 128 | 129 |
| Alpha WOLF 11 | NCIMB 42647 | 134 | 135 |
| Beta WOLF 11 | NCIMB 42647 | 136 | 137 |
| Alpha WOLF 12 | NCIMB 42650 | 138 | 139 |
| Alpha WOLF 15 | NCIMB 42466 | 130 | 131 |
| Alpha WOLF 16 | NCIMB 42820 | 151 | 152 |
| Alpha WOLF 17 | NCIMB 42818 | 153 | 154 |
| Alpha WOLF 18 | NCIMB 42819 | 161 | 162 |
| Alpha WOLF 19 | NCIMB 42822 | 163 | 164 |
| Alpha WOLF 20 | NCIMB 42821 | 165 | 166 |
| Alpha WOLF 21 | | 167 | 168 |
| Alpha WOLF 22 | | 169 | 170 |

Table 3. Introduction of one or more WOLF alleles results in a modification of the resistance profile of susceptible spinach variety Viroflay.

A "–" means complete resistance against a particular downy mildew race; "(–)" means intermediate resistance against a particular downy mildew race; "+" means that the allele confers no resistance and would cause a plant only carrying that particular allele to be susceptible for that particular downy mildew race. When an intermediate resistance response against a particular downy mildew race is only observed in the homozygous state of a particular allele this is indicated as "( )*". In case a resistance against a particular downy mildew race is only observed in the homozygous state of a particular allele, and the resistance for that allele in heterozygous state to that particular downy mildew race is intermediate this is indicated as "**–"

TABLE 3

| Allele name | Deposit number | Genomic SEQ ID No: | Promoter SEQ ID No: | cDNA SEQ ID No: | Protein SEQ ID No: |
|---|---|---|---|---|---|
| Beta WOLF 0 | NCIMB 42643 | 4 | 5 | 6 | 7 |
| Alpha WOLF 2 | NCIMB 42652 | 8 | 9 | 10 | 11 |
| Alpha WOLF 2a | NCIMB 42642 | 12 | 13 | 14 | 15 |
| Beta WOLF 3 | NCIMB 42652 | 16 | 17 | 18 | 19 |
| Alpha WOLF 4 | NCIMB 42655 | 20 | 21 | 22 | 23 |
| Alpha WOLF 4a | NCIMB 42645 | 24 | 25 | 26 | 27 |
| Beta WOLF 5a | NCIMB 42649 | 28 | 29 | 30,31 | 32,33 |
| Beta WOLF 5b | | 34 | 35 | 36 | 37 |
| Alpha WOLF 6 | NCIMB 42654 | 38 | 39 | 40,41 | 42,43 |
| Alpha WOLF 6b | NCIMB 42648 | 44 | 45 | 46,47 | 48,49 |
| Beta WOLF 6b | | 50 | 51 | 52 | 53 |
| Alpha WOLF 6c | NCIMB 42644 | 54 | 55 | 56,57 | 58,59 |
| Alpha WOLF 7 | NCIMB 42653 | 60 | 61 | 62 | 63 |
| Alpha WOLF 8 | NCIMB 42646 | 64 | 65 | 66,67,68 | 69,70,71 |
| Alpha WOLF 10 | NCIMB 42656 | 72 | 73 | 74 | 75 |
| Alpha WOLF 15 | NCIMB 42466 | 76 | 77 | 78,79 | 80,81 |
| Alpha WOLF 9 | NCIMB 42656 | 82 | 83 | 84 | 85 |
| Beta WOLF 9 | | 86 | 87 | 88 | 89 |
| Alpha WOLF 11 | NCIMB 42647 | 90 | 91 | 92,93 | 94,95 |
| Beta WOLF 11 | | 96 | 97 | 98,99 | 100,101 |
| Alpha WOLF 12 | NCIMB 42650 | 102 | 103 | 104,105 | 106,107 |
| Alpha WOLF16 | NCIMB 42820 | 145 | 146 | 147, 148 | 149, 150 |
| Alpha WOLF17 | NCIMB 42818 | | | | |
| Alpha WOLF18 | NCIMB 42819 | 155 | 156 | 157, 158 | 159, 160 |
| Alpha WOLF19 | NCIMB 42822 | | | | |
| Alpha WOLF20 | NCIMB 42821 | | | | |
| Alpha WOLF21 | | | | | |
| Alpha WOLF22 | | | | | |

| Allele name | Pfs: Resistance profile conferred by the constructs ||||||||||||||||| 
|---|---|---|---|---|---|---|---|---|---|---|---|---|---|---|---|---|---|
| | 1 | 2 | 3 | 4 | 5 | 6 | 7 | 8 | 9 | 10 | 11 | 12 | 13 | 14 | 15 | 16 | US1508 |
| Beta WOLF 0 | + | + | + | + | + | + | + | + | + | + | + | + | + | + | + | + | + |
| Alpha WOLF 2 | – | – | + | + | + | (–) | + | + | + | + | + | + | + | + | + | + | + |
| Alpha WOLF 2a | + | – | + | + | + | + | + | + | + | + | + | + | + | – | + | + | + |
| Beta WOLF 3 | – | + | – | + | – | + | + | (–) | – | + | – | – | + | – | + | – | – |
| Alpha WOLF 4 | – | – | – | – | + | + | + | + | + | + | + | + | + | – | + | – | |
| Alpha WOLF 4a | – | – | (–) | – | + | + | + | + | + | + | + | + | + | – | + | nt | |
| Beta WOLF 5a | – | + | – | + | – | + | + | + | + | + | + | + | + | + | + | + | |
| Beta WOLF 5b | | | | | | | | | | | | | | | | | |

TABLE 3-continued

| | | | | | | | | | | | | | | | | | |
|---|---|---|---|---|---|---|---|---|---|---|---|---|---|---|---|---|---|
| Alpha WOLF 6 | − | − | − | − | − | − | + | + | − | + | − | − | − | − | − | + | + |
| Alpha WOLF 6b | | | | | | | | | | | | | | | | | |
| Beta WOLF 6b | | | | | | | | | | | | | | | | | |
| Alpha WOLF 6c | − | − | − | − | − | − | + | + | − | + | − | − | − | − | − | + | − |
| Alpha WOLF 7 | − | − | − | − | − | − | + | − | + | − | + | − | + | − | − | − | − |
| Alpha WOLF 8 | − | − | + | + | (−)* | − | + | − | + | (−)* | + | + | + | + | − | (−) | nt |
| Alpha WOLF 10 | − | − | − | − | − | − | − | − | − | − | + | + | + | + | − | + | + |
| Alpha WOLF 15 | − | − | − | − | − | − | + | −** | − | (−) | − | − | − | − | − | + | − |
| Alpha WOLF 9 | − | − | − | − | − | − | − | − | − | − | − | − | − | + | + | + | + |
| Beta WOLF 9 | | | | | | | | | | | | | | | | | |
| Alpha WOLF 11 | − | + | − | − | − | (−)* | − | + | + | + | − | + | − | + | − | − | − |
| Beta WOLF 11 | | | | | | | | | | | | | | | | | |
| Alpha WOLF 12 | − | − | − | − | + | − | − | − | − | − | − | − | − | + | + | + | + |
| Alpha WOLF 16 | − | − | − | − | − | nt | + | nt | nt | nt | − | − | − | − | − | + | − |
| Alpha WOLF 17 | nt | − | nt | − | nt | nt | + | nt | nt | nt | − | − | − | − | − | + | nt |
| Alpha WOLF 18 | nt | nt | nt | nt | nt | nt | nt | nt | nt | − | nt | nt | − | − | − | + | nt |
| Alpha WOLF 19 | − | − | − | (−)* | − | − | − | − | − | − | − | − | − | − | − | + | nt |
| Alpha WOLF20 | − | − | − | − | + | − | − | − | − | − | − | − | nt | + | + | + | nt |
| Alpha WOLF21 | −** | (−)* | −** | −** | − | − | (−) | −** | − | −** | + | + | + | + | − | + | nt |
| Alpha WOLF22 | − | − | + | + | nt | − | + | − | + | + | + | + | + | + | − | nt | nt |

Lengthy table referenced here

US11254949-20220222-T00001

Please refer to the end of the specification for access instructions.

Although the present invention and its advantages have been described in detail, it should be understood that various changes, substitutions and alterations can be made herein without departing from the spirit and scope of the invention as defined in the appended claims.

The present invention will be further illustrated in the following Examples which are given for illustration purposes only and are not intended to limit the invention in any way.

EXAMPLES

Example 1: Testing for Resistance to *Peronospora farinosa* f. Sp. *Spinaciae* in Spinach Plants The resistance to downy mildew infection was assayed as described by Irish et al. (2008; *Phytopathol.* 98: 894-900), using a differential set. Spinach plants of the invention were sown along with spinach plants from different other genotypes (see Table 1) in trays containing Scotts Redi-Earth medium, and fertilized twice a week after seedling emergence with Osmocote Peter's (13-13-13) fertilizer (Scotts). Plants were inoculated with a sporangial suspension (2.5× $10^5$/ml) of a pathogenic race of *Peronospora farinosa* f. sp. *spinaciae* at the first true leaf stage. In this manner, 16 officially recognized pathogenic races were tested, as well as pathogenic isolate US1508 (as shown in Table 1). *Peronospora farinosa* f. sp. *spinaciae* isolate US1508 has been reported to the NAK Tuinbouw, Sotaweg 22, 2371 GD Roelofarendsveen as a candidate for official denomination as a new *Peronospora farinosa* f. sp. *spinaciae* race. Along with the 16 officially recognised *Peronospora* races, this isolate is available from Rijk Zwaan, Burgemeester Crezéelaan 40, 2678 KX De Lier.

The inoculated plants were placed in a dew chamber at 18° C. with 100% relative humidity for a 24 h period, and then moved to a growth chamber at 18° C. with a 12 h photoperiod for 6 days. After 6 days, the plants were returned to the dew chamber for 24 h to induce sporulation, and they were scored for disease reaction.

Plants for this specific test were scored as resistant, intermediately resistant, or susceptible based on symptoms of chlorosis and signs of pathogen sporulation on the cotyledons and true leaves, as described by Irish et al. (2007; *Plant Dis.* 91: 1392-1396). Plants exhibiting no evidence of chlorosis and sporulation were in this specific test considered as resistant. Resistant plants were re-inoculated to assess whether plants initially scored as resistant had escaped infection, or whether they were truly resistant. Plants that showed only symptoms of chlorosis, or sporulation occurring only on the tips of the cotyledons were scored as intermediately resistant. Plants showing more than these symptoms of downy mildew infection were scored as being susceptible.

Table 1 shows the differential set of spinach downy mildew races and the resistance of various spinach varieties (hybrids) to each one of these pathogenic races.

Example 2: Identification of WOLF Alleles that Confer Resistance to Peronospora farinosa f Sp. Spinaciae in Spinach A large number of genetically different spinach plants was phenotypically tested for resistance to various pathogenic races and isolates of Peronospora farinosa f. sp. spinaciae, using the assay described in Example 1. Genomic DNA was subsequently isolated from plants that showed resistance to one or more pathogenic races or isolates. The goal of this experiment was to identify one or more WOLF alleles that are responsible for the resistance in those spinach plants. Table 2 gives an overview of the plants that were used in this experiment.

The isolated genomic DNA was used in polymerase chain reactions (PCR), using forward primer ACAAGTGGATGTGTCTTAGG (SEQ ID NO:1) and reverse primer TTCGCCCTCATCTTCCTGG (SEQ ID NO:2) for the identification of alpha-type WOLF alleles, and forward primer TCACGTGGGTTGTGTTGT (SEQ ID NO:3) and reverse primer TTCGCCCTCATCTTCCTGG (SEQ ID NO:2) for the identification of beta-type WOLF alleles. Said primer pairs amplify the LRR domain-encoding region of a WOLF allele, and they have been designed for selectively amplifying a part of a WOLF gene, and not of other CC-NBS-LRR protein-encoding genes.

If PCR products were subsequently to be Sanger sequenced, PCR conditions were as follows, using Platinum Taq enzyme (Thermo Fisher Scientific):
Primer pair with SEQ ID NO:1 and SEQ ID NO:2:
3 minutes at 95° C. (initial denaturing step)
40 amplification cycles, each cycle consisting of: 30 seconds denaturation at 95° C., 30 seconds annealing at 60° C., and 30 seconds extension at 72° C.
2 minutes at 72° C. (final extension step)
Primer pair SEQ ID NO:3 and SEQ ID NO:2:
3 minutes at 95° C. (initial denaturing step)
40 amplification cycles, each cycle consisting of: 30 seconds denaturation at 95° C., 50 seconds annealing at 58° C. and 50 seconds extension at 72° C.
2 minutes at 72° C. (final extension step)

Sanger sequencing, however, is only possible when a plant harbours in its genome a single alpha-type WOLF allele and/or a single beta-type WOLF allele, because the presence of multiple PCR-amplicons in the sequencing reaction would frustrate adequate Sanger sequencing, and the resulting sequence would be an average of all different fragments that are present in the mixture. In case a spinach plant is suspected to harbor multiple alpha- and/or beta-WOLF alleles in its genome, said plant can be inbred by means of selfing, and among the progeny individuals can be identified that are homozygous for a the alpha- and/or beta-WOLF alleles. Alternatively, if said plant harbours in its genome only alpha-type WOLF alleles and no beta-type WOLF alleles, it can be crossed to susceptible spinach variety Viroflay, which harbours in its genome a single beta-type WOLF gene. In the progeny of this cross it will then be possible to specifically PCR-amplify an alpha-type WOLF allele, because Viroflay only has an endogenous beta-type WOLF allele, and no alpha-type WOLF alleles. When a plant harbours in its genome more than one alpha-type and/or beta-type WOLF allele, next-generation sequencing is a good alternative. For example, SMRT sequencing (Pacific Biosciences) can be used to simultaneously identify multiple alpha-type WOLF genes in a genome, or multiple beta-type WOLF alleles.

If PCR products were to be sequenced using SMRT sequencing (Pacific Biosciences), PCR primers and PCR conditions were different. To the above-mentioned forward primers the following standard amplification sequence was added: GCAGTCGAACATGTAGCTGACTCAGGTCAC (SEQ ID NO: 140). To the reverse primer, the following standard amplification sequence was added: TGGATCACTTGTGCAAGCATCACATCGTAG (SEQ ID NO:141). The three primers used for PCR prior to SMRT sequencing thus comprised in their sequence SEQ ID NO:1, SEQ ID NO:2 and SEQ ID NO:3, respectively.

For the identification of alpha-type WOLF genes with primers GCAGTCGAACATGTAGCTGACTCAGGTCACACAAGTGGATGTGTCTTAGG (SEQ ID NO:142) and TGGATCACTTGTGCAAGCATCACATCGTAGTTCGCCCTCATCTTCCTGG (SEQ ID NO:143), PCR conditions were as follows, using KAPA HiFi Hotstart polymerase (Kapa Biosystems):
3 minutes at 98° C. (initial denaturing step)
35 amplification cycles, each cycle consisting of: 30 seconds denaturation at 98° C., 20 seconds annealing at 58° C., and 60 seconds extension at 72° C.
3 minutes at 72° C. (final extension step)

For the identification of beta-type WOLF genes with primers GCAGTCGAACATGTAGCTGACTCAGGTCACTCACGTGGGTTGTGTTGT (SEQ ID NO:144) and TGGATCACTTGTGCAAGCATCACATCGTAGTTCGCCCTCATCTTCCTGG (SEQ ID NO:143), PCR conditions were as follows, using KAPA HiFi Hotstart polymerase (Kapa Biosystems):
3 minutes at 98° C. (initial denaturing step)
35 amplification cycles, each cycle consisting of: 30 seconds denaturation at 98° C., 20 seconds annealing at 65° C., and 60 seconds extension at 72° C.
3 minutes at 72° C. (final extension step)

The manufacturer's protocol for preparing SMRTbell™ Libraries using PacBio© Barcoded Universal Primers for Multiplex SMRT© Sequencing was followed, using molecular barcoding.

The PCR products were visualised on agarose gel, and for all reactions that yielded a PCR product, DNA was purified from the PCR reaction, and the sequence of the PCR products was subsequently determined. Examples of PCR products on agarose gel can be seen in FIG. 1 and FIG. 2, for identification of alpha- and beta-type WOLF alleles respectively.

In Table 2 an overview is given of different sequences that were obtained in this experiment, by means of SMRT sequencing. These sequences each correspond to the LRR-domain-encoding region of a WOLF allele, and the encoded sequences of the LRR-domain are also presented. Table 2 also shows the biological material where each sequence has been amplified from, and which has been deposited with the NCIMB. All NCIMB deposit numbers are also mentioned in this table. The WOLF alleles have been named according to their type (alpha or beta), and numbered.

Beta WOLF 0 does not confer resistance and is not part of the invention.

Example 3: Modifying a Spinach Plant's Resistance Profile to Peronospora farinosa f. Sp. Spinaciae Using a Nucleic Acid Construct Spinach plants of variety Viroflay are transformed with a number of different nucleic acid constructs, each construct comprising one or more copies of a WOLF allele. The WOLF alleles used in this experiment have been obtained from different spinach plants. The alleles were identified after sequencing the genome of a collection of spinach plants, and searching therein for alleles that have all characteristics of an alpha- or beta-type WOLF allele, as defined elsewhere in this application.

For insertion into a nucleic acid construct, the genomic sequences of WOLF alleles are PCR-amplified from the genome of the spinach plants, along with their endogenous promoter sequences. For most of the alleles the promoter is defined as a region of 2000 bp upstream from the ATG start codon of the gene. Table 3 gives an overview of the nucleic acid constructs that are used, and of the biological source they were isolated from.

Spinach transformation is performed as described (Zhang and Zeevaart, 1999, *Plant Cell Rep* 18: 640-645), and for each construct three independent T0 transformants with a single copy of the transgene are selected. The T0 plants are then self-fertilised, and the T1 seeds produced from these selfings are collected. The T1 seeds are sown on kanamycin-containing selection medium in order to confirm again the presence of the nucleic acid construct in their genome, and successfully grown plants are transferred to soil for further development. T1 plants that harbour in their genome a single copy of the nucleic acid construct in a homozygous state are selected, and these plants are allowed to self-fertilise, and T2 seeds are harvested therefrom. These T2 seeds are grown into plants, and used for disease-resistance testing.

Disease-resistance testing of the spinach plants is performed as described in Example 1, with different pathogenic races of *Peronospora farinosa* f sp. *spinaciae*. All 16 officially recognised pathogenic races and isolate US1508 are included in this assay, and positive and negative control plants are also included in the experiment. Suitable control plants for each race or isolate are selected from the differential reference set, and as an additional negative control, Viroflay plants harbouring an empty nucleic acid construct (i.e. the same vector as used for the experimental setup, but lacking a WOLF gene in its multicloning site) are used.

In this experiment, the following nucleic acid constructs are used, as illustrated in Table 3:

1) The BetaWOLF 0 allele, with genomic sequence corresponding to SEQ ID NO: 4, is expressed in Viroflay under control of its native promoter (SEQ ID NO:5). Both sequences have been amplified from the genome of NCIMB deposit number 42463, wherein they are present in a homozygous state. The allele's coding sequence is given in SEQ ID NO:6, and it encodes the protein sequence of SEQ ID NO:7. In the Viroflay background, this construct does not modify the resistance profile to *Peronospora farinosa* f sp. *spinaciae*, as it remains susceptible to all tested pathogenic races and isolates.

2) The AlphaWOLF 2 allele, with genomic sequence corresponding to SEQ ID NO:8, is expressed in Viroflay under control of its native promoter (SEQ ID NO:9). Both sequences have been amplified from the genome of NCIMB deposit number 42652, wherein they are present in a heterozygous state. The allele's coding sequence is given in SEQ ID NO:10, and it encodes the protein sequence of SEQ ID NO:11. This construct modifies Viroflay's resistance profile to *Peronospora farinosa* f. sp. *spinaciae*: it becomes resistant to at least Pfs1 and Pfs2, and partially resistant to Pfs6.

3) The AlphaWOLF 2a allele, with genomic sequence corresponding to SEQ ID NO:12, is expressed in Viroflay under control of its native promoter (SEQ ID NO:13). Both sequences have been amplified from the genome of NCIMB deposit number 42642, wherein they are present in a homozygous state. The allele's coding sequence is given in SEQ ID NO:14, and it encodes the protein sequence of SEQ ID NO:15. This construct modifies Viroflay's resistance profile to *Peronospora farinosa* f. sp. *spinaciae*: it becomes resistant to at least Pfs2 and Pfs15.

4) The BetaWOLF 3 allele, with genomic sequence corresponding to SEQ ID NO:16, is expressed in Viroflay under control of its native promoter (SEQ ID NO:17). Both sequences have been amplified from the genome of NCIMB deposit number 42652, wherein they are present in a heterozygous state. The allele's coding sequence is given in SEQ ID NO:18, and it encodes the protein sequence of SEQ ID NO:19. This construct modifies Viroflay's resistance profile to *Peronospora farinosa* f. sp. *spinaciae*: it becomes resistant to at least Pfs1, Pfs3, Pfs5, Pfs9, Pfs11, Pfs12, Pfs14, Pfs16 and US1508, and partially resistant to Pfs 8.

5) The AlphaWOLF 4 allele, with genomic sequence corresponding to SEQ ID NO:20, is expressed in Viroflay under control of its native promoter (SEQ ID NO:21). Both sequences have been amplified from the genome of NCIMB deposit number 42655, wherein they are present in a heterozygous state. The allele's coding sequence is given in SEQ ID NO:22, and it encodes the protein sequence of SEQ ID NO:23. This construct modifies Viroflay's resistance profile to *Peronospora farinosa* f. sp. *spinaciae*: it becomes resistant to at least Pfs1, Pfs2, Pfs3, Pfs4, Pfs15 and US1508.

6) The AlphaWOLF 4a allele, with genomic sequence corresponding to SEQ ID NO:24, is expressed in Viroflay under control of its native promoter (SEQ ID NO:25). Both sequences have been amplified from the genome of NCIMB deposit number 42645, wherein they are present in a homozygous state. The allele's coding sequence is given in SEQ ID NO:26, and it encodes the protein sequence of SEQ ID NO:27. This construct modifies Viroflay's resistance profile to *Peronospora farinosa* f. sp. *spinaciae*: it becomes resistant to at least Pfs1, Pfs2, Pfs4, Pfs15, and partially resistant to Pfs3. Isolate US1508 has not been tested.

7) The BetaWOLF 5a and BetaWOLF 5b alleles, with genomic sequences corresponding to SEQ ID NO:28 and SEQ ID NO:34 respectively, are each expressed under control of their native promoters (SEQ ID NO:29 and SEQ ID NO:35, respectively). All sequences have been amplified from the genome of NCIMB deposit number 42649, wherein they are present in a homozygous state. Two alternative coding sequences (splice variants) of the BetaWOLF 5a allele are given in SEQ ID NO:30 and SEQ ID NO:31, and they encode the protein sequences of SEQ ID NO:32 and SEQ ID NO:33, respectively. The coding sequence of the BetaWOLF 5b allele is given in SEQ ID NO:36, and it encodes the protein sequence of SEQ ID NO:37. This construct comprising the BetaWOLF 5a and BetaWOLF 5b alleles modifies Viroflay's resistance profile to *Peronospora farinosa* f. sp. *spinaciae*: it becomes resistant to at least Pfs1, Pfs3 and Pfs5.

8) The AlphaWOLF 6 allele, with genomic sequence corresponding to SEQ ID NO:38, is expressed in Viroflay under control of its native promoter (SEQ ID NO:39). Both sequences have been amplified from the genome of NCIMB deposit number 42654, wherein they are present in a heterozygous state. Two alternative coding sequences (splice variants) of the AlphaWOLF 6 allele are given in SEQ ID NO:40 and SEQ ID NO:41, and they encode the protein sequences of SEQ ID NO:42 and SEQ ID NO:43, respectively. This construct modifies Viroflay's resistance profile to *Peronospora farinosa* f. sp. *spinaciae*: it becomes resistant to at least Pfs1, Pfs2, Pfs3, Pfs4, Pfs5, Pfs6, Pfs9, Pfs11, Pfs12, Pfs13, Pfs14 and Pfs15.

9) The AlphaWOLF 6b and BetaWOLF 6b alleles, with genomic sequences corresponding to SEQ ID NO:44 and SEQ ID NO:50 respectively, are each expressed under control of their native promoters (SEQ ID NO:45 and SEQ ID NO:51, respectively). All sequences have been amplified from the genome of NCIMB deposit number 42648, wherein they are present in a homozygous state. Two alternative coding sequences (splice variants) of the AlphaWOLF 6b allele are given in SEQ ID NO:46 and SEQ ID NO:47, and they encode the protein sequences of SEQ ID NO:48 and SEQ ID NO:49, respectively. The coding sequence of the BetaWOLF 6b allele is given in SEQ ID NO:52, and it encodes the protein sequence of SEQ ID NO:53. This construct comprising the AlphaWOLF 6b and BetaWOLF 6b alleles modifies Viroflay's resistance profile to *Peronospora farinosa* f. sp. *spinaciae*: it becomes resistant to at least Pfs1, Pfs2, Pfs3, Pfs4, Pfs5, Pfs6, Pfs9, Pfs11, Pfs12, Pfs13, Pfs14, Pfs15 and US1508.

10) The AlphaWOLF 6c allele, with genomic sequence corresponding to SEQ ID No: 54, is expressed in Viroflay under control of its native promoter (SEQ ID NO:55). Both sequences have been amplified from the genome of NCIMB deposit number 42644, wherein they are present in a homozygous state. Two alternative coding sequences (splice variants) of the AlphaWOLF 6c allele are given in SEQ ID NO:56 and SEQ ID NO:57, and they encode the protein sequences of SEQ ID NO:58 and SEQ ID NO:59, respectively. This construct modifies Viroflay's resistance profile to *Peronospora farinosa* f. sp. *spinaciae*: it becomes resistant to at least Pfs1, Pfs2, Pfs3, Pfs4, Pfs5, Pfs6, Pfs9, Pfs11, Pfs12, Pfs13, Pfs14, Pfs15 and US1508.

11) The AlphaWOLF 7 allele, with genomic sequence corresponding to SEQ ID NO:60, is expressed in Viroflay under control of its native promoter (SEQ ID NO:61). Both sequences have been amplified from the genome of NCIMB deposit number 42653, wherein they are present in a heterozygous state. The allele's coding sequence is given in SEQ ID NO:62, and it encodes the protein sequence of SEQ ID NO:63. This construct modifies Viroflay's resistance profile to *Peronospora farinosa* f. sp. *spinaciae*: it becomes resistant to at least Pfs1, Pfs2, Pfs3, Pfs4, Pfs5, Pfs6, Pfs7, Pfs9, Pfs11, Pfs13, Pfs15, Pfs16 and US1508.

12) The AlphaWOLF 8 allele, with genomic sequence corresponding to SEQ ID NO:64, is expressed in Viroflay under control of its native promoter (SEQ ID NO:65). Both sequences have been amplified from the genome of NCIMB deposit number 42646, wherein they are present in a homozygous state. Three alternative coding sequences (splice variants) of the AlphaWOLF 8 allele are given in SEQ ID NO:66, SEQ ID NO:67 and SEQ ID NO:68, and they encode the protein sequences of SEQ ID NO:69, SEQ ID NO:70 and SEQ ID NO:71, respectively. This construct modifies Viroflay's resistance profile to *Peronospora farinosa* f. sp. *spinaciae*: when the construct is present in homozygous state the plant becomes resistant to at least Pfs1, Pfs2, Pfs6, Pfs8 and Pfs15, and partially resistant to Pfs5, Pfs10 and Pfs16.

13) The AlphaWOLF 10 allele, with genomic sequence corresponding to SEQ ID NO:72, is expressed in Viroflay under control of its native promoter (SEQ ID NO:73). Both sequences have been amplified from the genome of NCIMB deposit number 42656, wherein they are present in a heterozygous state. The allele's coding sequence is given in SEQ ID NO:74, and it encodes the protein sequence of SEQ ID NO:75. This construct modifies Viroflay's resistance profile to *Peronospora farinosa* f. sp. *spinaciae*: it becomes resistant to at least Pfs1, Pfs2, Pfs3, Pfs4, Pfs5, Pfs6, Pfs7, Pfs8, Pfs9, Pfs10 and Pfs15.

14) The AlphaWOLF 15 allele, with genomic sequence corresponding to SEQ ID NO:76, is expressed in Viroflay under control of its native promoter (SEQ ID NO:77). Both sequences have been amplified from the genome of NCIMB deposit number 42466, wherein they are present in a homozygous state. Two alternative coding sequences (splice variants) of the AlphaWOLF 6c allele are given in SEQ ID NO:78 and SEQ ID NO:79, and they encode the protein sequences of SEQ ID NO:80 and SEQ ID NO:81, respectively. This construct modifies Viroflay's resistance profile to *Peronospora farinosa* f. sp. *spinaciae*: when the construct is present in homozygous state the plant becomes resistant to at least Pfs1, Pfs2, Pfs3, Pfs4, Pfs5, Pfs6, Pfs8, Pfs9, Pfs11, Pfs12, Pfs13, Pfs14, Pfs15 and US1508, and partially resistant to Pfs10.

15) The AlphaWOLF 9 and BetaWOLF 9 alleles, with genomic sequences corresponding to SEQ ID NO:82 and SEQ ID NO:86 respectively, are each expressed under control of their native promoters (SEQ ID NO:83 and SEQ ID NO:87, respectively). All sequences have been amplified from the genome of NCIMB deposit number 42656, wherein they are present in a heterozygous state. The coding sequence of the AlphaWOLF 9 allele is given in SEQ ID NO:84, and it encodes the protein sequence of SEQ ID NO:85. The coding sequence of the BetaWOLF 9 allele is given in SEQ ID NO:88, and it encodes the protein sequence of SEQ ID NO:89. This construct comprising the AlphaWOLF 9 and BetaWOLF 9 alleles modifies Viroflay's resistance profile to *Peronospora farinosa* f. sp. *spinaciae*: it becomes resistant to at least Pfs1, Pfs2, Pfs3, Pfs4, Pfs5, Pfs6, Pfs7, Pfs8, Pfs9, Pfs10, Pfs11, Pfs12 and Pfs13.

16) The AlphaWOLF 11 and BetaWOLF 11 alleles, with genomic sequences corresponding to SEQ ID NO:90 and SEQ ID NO:96 respectively, are each expressed under control of their native promoters (SEQ ID NO:91 and SEQ ID NO:97, respectively). All sequences have been amplified from the genome of NCIMB deposit number 42647, wherein they are present in a homozygous state. Two alternative coding sequences (splice variants) of the AlphaWOLF 11 allele are given in SEQ ID NO:92 and SEQ ID NO:93, and they encode the protein sequences of SEQ ID NO:94 and SEQ ID NO:95, respectively. Two alternative coding sequences (splice variants) of the BetaWOLF 11 allele are given in SEQ ID NO:98 and SEQ ID NO:99, and they encode the protein sequences of SEQ ID NO:100 and SEQ ID NO:101, respectively. This construct comprising the AlphaWOLF 11 and BetaWOLF 11 alleles modifies Viroflay's resistance profile to *Peronospora farinosa* f. sp. *spinaciae*: when the construct is present in homozygous state the plant becomes resistant to at least Pfs1, Pfs3, Pfs4, Pfs5, Pfs7, Pfs11, Pfs13, Pfs15, Pfs16 and US1508, and partially resistant to Pfs6.

17) The AlphaWOLF 12 allele, with genomic sequence corresponding to SEQ ID NO:102, is expressed in Viroflay under control of its native promoter (SEQ ID NO:103). Both sequences have been amplified from the genome of NCIMB deposit number 42650, wherein they are present in a heterozygous state. Two alternative coding sequences (splice variants) of the AlphaWOLF 12 allele are given in SEQ ID NO:104 and SEQ ID NO:105, and they encode the protein sequences of SEQ ID NO:106 and SEQ ID NO:107, respectively. This construct modifies Viroflay's resistance profile to *Peronospora farinosa* f sp. *spinaciae*: it becomes resistant to at least Pfs1, Pfs2, Pfs3, Pfs4, Pfs6, Pfs7, Pfs8, Pfs9, Pfs10, Pfs11, Pfs12 and Pfs13.

18) The AlphaWOLF 16 allele, with genomic sequence corresponding to SEQ ID NO:145, is expressed in Viroflay under control of its native promoter (SEQ ID NO:146). Both sequences have been amplified from the genome of NCIMB deposit number 42820, wherein they are present in a homozygous state. Two alternative coding sequences (splice variants) of the AlphaWOLF 16 allele are given in SEQ ID NO:147 and SEQ ID NO:148, and they encode the protein sequences of SEQ ID NO:149 and SEQ ID NO:150, respectively. This construct modifies Viroflay's resistance profile to *Peronospora farinosa* f. sp. *spinaciae*: it becomes resistant to at least Pfs1, Pfs2, Pfs3, Pfs4, Pfs5, Pfs11, Pfs12, Pfs13, Pfs14, Pfs15 and US1508.

19) The AlphaWOLF 18 allele, with genomic sequence corresponding to SEQ ID NO:155, is expressed in Viroflay under control of its native promoter (SEQ ID NO:156). Both sequences have been amplified from the genome of NCIMB deposit number 42819, wherein they are present in a homozygous state. Two alternative coding sequences (splice variants) of the AlphaWOLF 18 allele are given in SEQ ID NO:157 and SEQ ID NO:158, and they encode the protein sequences of SEQ ID NO:159 and SEQ ID NO:160, respectively. This construct modifies Viroflay's resistance profile to *Peronospora farinosa* f. sp. *spinaciae*: it becomes resistant to at least Pfs10, Pfs13, Pfs14 and Pfs15.

As illustrated by Table 3, introducing one or more WOLF alleles into the genome of a spinach plant thus results in a modification of the resistance profile to *Peronospora farinosa* f. sp. *spinaciae*.

In another experiment, a spinach plant that is already resistant to various pathogenic races and isolates of *Peronospora farinosa* f. sp. *spinaciae* is transformed with a number of different nucleic acid constructs, each construct comprising one or more copies of a WOLF allele. The approach is similar as described above, with the exception that—unlike Viroflay—the transformed plant already displays a certain resistance profile. This approach allows the stacking of WOLF alleles in a spinach plant's genome, to further modify and/or strengthen that plant's resistance profile.

The AlphaWOLF 7 allele, with genomic sequence corresponding to SEQ ID NO:60, is expressed in a plant from deposit NCIMB 42466 under control of its native promoter (SEQ ID NO:61). Both sequences have been amplified from the genome of NCIMB deposit number 42653, wherein they are present in a heterozygous state. The allele's coding sequence is given in SEQ ID NO:62, and it encodes the protein sequence of SEQ ID NO:63. This construct modifies the transformed plant's resistance profile to *Peronospora farinosa* f. sp. *spinaciae*. Said plant was already resistant to Pfs1, Pfs2, Pfs3, Pfs4, Pfs5, Pfs6, Pfs8, Pfs9, Pfs11, Pfs12, Pfs13, Pfs14, Pfs15 and US1508, and partially resistant to Pfs10, but after introduction of said nucleic acid construct its resistance profile is broadened: it now also becomes resistant to Pfs7 and Pfs16, but remains partially resistant to Pfs10. This transformed plant is thus (at least partially) resistant to all 17 pathogenic races and isolates that have been used in our phenotypical test.

Example 4: Identifying and Selecting a New WOLF Allele

The knowledge that the WOLF gene is responsible for resistance to *Peronospora farinosa* f. sp. *spinaciae* makes it possible to identify plants carrying new alleles with a new resistance profile that, upon introduction into the genome of a spinach plant, modifies the resistance profile of said spinach plant to *Peronospora farinosa* f. sp. *spinaciae*. In the search for possible new WOLF alleles a part of the internal gene bank collection was screened by determining the sequence of the LRR domain of the WOLF gene as described in Example 2.

These sequences were translated into amino acid sequences and subsequently evaluated by comparing them with the already identified amino acid sequences of the LRR domains of alpha/beta alleles 0 to 15 as mentioned in Table 2. Identical or substantially identical sequences, i.e. sequences that have silent mutations or mutations leading to a conserved amino acid change were discarded as well as sequences that have mutations leading to premature stop codons and/or frameshifts.

The accessions that remained were multiplied and subjected to seedling tests for several different races of *Peronospora farinosa* f. sp. *spinaciae*. The results of these seedling tests showed that seven new alpha-WOLF alleles were identified having a unique sequence and resistance profile. These seven alleles were denominated Alpha-WOLF 16 to 22 and were added to Tables 2 and 3. These alleles are all candidates for developing parent lines for new spinach varieties with an extended resistance profile. For example, the accession carrying the Alpha-WOLF 19 was used to develop a parental line. This parental line was combined with a parental line carrying the alpha-WOLF 7 allele leading to a hybrid variety resistant against pfs:1-16 and isolate US1508.

The alpha-WOLF 16 allele has a genomic sequence corresponding to SEQ ID NO:145 and has a LRR domain with a nucleotide and amino acid sequence corresponding to SEQ ID NO:151 and SEQ ID NO: 152, respectively. The alpha-WOLF 16 allele is homozygously present in a seeds deposited under NCIMB 42820. The homozygous presence of Alpha WOLF 16 allele in a spinach plant leads to resistance against at least *Peronospora farinosa* f. sp. *spinaciae* races Pfs1, Pfs2, Pfs3, Pfs4, Pfs5, Pfs11, Pfs12, Pfs13, Pfs14, Pfs15 and US1508.

The alpha-WOLF 17 allele has a LRR domain with a nucleotide and amino acid sequence corresponding to SEQ ID NO:153 and SEQ ID NO: 154, respectively. The alpha-WOLF 17 allele is homozygously present in a seeds deposited under NCIMB 42818. The homozygous presence of Alpha WOLF 17 allele in a spinach plant leads to resistance against at least *Peronospora farinosa* f. sp. *spinaciae* races Pfs2, Pfs4, Pfs11, Pfs12, Pfs13, Pfs14 and Pfs15.

The alpha-WOLF 18 allele has a genomic sequence corresponding to SEQ ID NO:155 and having a LRR domain with a nucleotide and amino acid sequence corresponding to SEQ ID NO:161 and SEQ ID NO: 162, respectively. The alpha-WOLF 18 allele is homozygously present in a seeds deposited under NCIMB 42819. The homozygous presence of Alpha WOLF 19 allele in a spinach plant leads to resistance against at least *Peronospora farinosa* f. sp. *spinaciae* races Pfs10, Pfs13 and Pfs14.

The alpha-WOLF 19 allele has a LRR domain with a nucleotide and amino acid sequence corresponding to SEQ ID NO:163 and SEQ ID NO: 164, respectively. The alpha-WOLF 19 allele is homozygously present in a seeds deposited under NCIMB 42822. The homozygous presence of Alpha WOLF 19 allele in a spinach plant leads to resistance against at least *Peronospora farinosa* f. sp. *spinaciae* races Pfs1, Pfs2, Pfs3, Pfs5, Pfs6, Pfs7, Pfs8, Pfs9, Pfs10 Pfs11, Pfs12, Pfs13, Pfs14, Pfs15 and intermediate resistance to Pfs4.

The alpha-WOLF 20 allele has a LRR domain with a nucleotide and amino acid sequence corresponding to SEQ ID NO:165 and SEQ ID NO: 166, respectively. The alpha-WOLF 20 allele is homozygously present in a seeds deposited under NCIMB 42821. The homozygous presence of Alpha WOLF 20 allele in a spinach plant leads to resistance against at least *Peronospora farinosa* f. sp. *spinaciae* races Pfs1, Pfs2, Pfs3, Pfs4, Pfs6, Pfs7, Pfs8, Pfs9, Pfs10, Pfs11 and Pfs12.

The alpha-WOLF 21 allele has a LRR domain with a nucleotide and amino acid sequence corresponding to SEQ ID NO:167 and SEQ ID NO: 168, respectively. The homozygous presence of Alpha WOLF 21 allele in a spinach plant leads to resistance against at least *Peronospora farinosa* f. sp. *spinaciae* races Pfs1, Pfs3, Pfs4, Pfs5, Pfs6, Pfs8, Pfs9, Pfs10, Pfs15 and intermediate resistance to Pfs2 and Pfs 7.

The alpha-WOLF 22 allele has a LRR domain with a nucleotide and amino acid sequence corresponding to SEQ ID NO:165 and SEQ ID NO: 166, respectively. The homozygous presence of Alpha WOLF 22 allele in a spinach plant leads to resistance against at least *Peronospora farinosa* f. sp. *spinaciae* races Pfs1, Pfs2, Pfs6, Pfs8 and Pfs15.

The invention is further described by the following numbered paragraphs:

1. A method for modifying the resistance profile of a spinach plant to *Peronospora farinosa* f. sp. *spinaciae*, comprising introducing a WOLF allele or a resistance-conferring part thereof into the genome of said spinach plant, or modifying an endogenous WOLF allele in the genome of said spinach plant, wherein the WOLF allele encodes a CC-NBS-LRR protein that comprises in its amino acid sequence:
    a) the motif "MAEIGYSVC" (SEQ ID NO:171) at its N-terminus, and
    b) the motif "KWMCLR" (SEQ ID NO:172) or "HVGCVVDR" (SEQ ID NO:173).
2. The method of paragraph 1, wherein the WOLF allele encodes a WOLF protein according to any one of SEQ ID NOs referred to in Table 3.
3. The method of paragraph 1 or 2, wherein introducing a WOLF allele into the genome of a spinach plant comprises the step of expressing in a spinach cell a recombinant nucleic acid construct comprising a coding sequence encoding one or more WOLF polypeptides.
4. The method of paragraph 3, wherein the nucleic acid construct is designed for stable incorporation into the genome of a plant cell.
5. The method of paragraph 1, wherein modifying the endogenous WOLF allele is achieved by means of genome editing techniques or mutagenesis techniques.
6. The method of paragraph 5, wherein the endogenous WOLF allele is replaced by a modified WOLF allele by means of genome editing techniques.
7. A spinach plant comprising a WOLF allele as defined in paragraph 1.
8. The spinach plant of paragraph 7, which is obtainable by the method of any one of the paragraphs 1-6.
9. The spinach plant according to paragraph 7 or 8, having a modified resistance profile to *Peronospora farinosa* f. sp. *spinaciae* as compared to an isogenic spinach plant that has not been modified by the method of any one of the paragraphs 1-6.
10. A spinach plant comprising one or more WOLF alleles, wherein said WOLF allele is selected from the nucleotide sequences referred to in Table 3 or is a nucleotide sequence encoding a polypeptide having an amino acid sequence referred to in Table 3 or is a nucleotide sequence encoding a polypeptide having a sequence similarity of 95%, 96%, 97%, 98%, or 99% with any one of the amino acid sequences referred to in Table 3, or a having a sequence similarity of 95%, 96%, 97%, 98%, or 99% with any one of the nucleotide sequences referred to in Table 3.
11. Propagation material of a plant of any one of the paragraphs 7-10, wherein a plant grown or regenerated from the material comprises a resistance-conferring WOLF allele as defined in paragraph 1.
12. A cell of a spinach plant of any one of the paragraphs 7-10, which cell comprises a WOLF allele as defined in paragraph 1.
13. A seed capable of growing into a spinach plant of any one of the paragraphs 7-10.
14. Harvested leaves of a spinach plant of any one of the paragraphs 7-10.
15. A food product comprising the harvested leaves of paragraph 14.
16. A WOLF allele having a nucleotide sequence selected from SEQ ID NO:8, SEQ ID NO:12, SEQ ID NO:16, SEQ ID NO:20, SEQ ID NO:24, SEQ ID NO:28, SEQ ID NO:34, SEQ ID NO:38, SEQ ID NO:44, SEQ ID NO:50, SEQ ID NO:54, SEQ ID NO:60, SEQ ID NO:64, SEQ ID NO:72, SEQ ID NO:76, SEQ ID NO:82, SEQ ID NO:86, SEQ ID NO:90, SEQ ID NO:96, SEQ ID NO:102, SEQ ID NO:145, SEQ ID NO:155.
17. A vector comprising a WOLF allele according to paragraph 16.
18. A spinach plant comprising the vector of paragraph 17.
19. A method for selecting a spinach plant comprising a novel WOLF allele that confers resistance to *Peronospora farinosa* f. sp. *spinaciae* in a spinach plant, comprising:
    a) determining the sequence of the LRR domain or part thereof of a WOLF allele in the genome of a spinach plant;
    b) comparing said sequence to the sequences referred to in Table 3;
    c) if the sequence of the LRR domain or part thereof is substantially different from the sequences referred to in Table 3, select the spinach plant that harbours said sequence in its genome as a spinach plant that comprises a novel WOLF allele.
20. The method of paragraph 19, wherein the selected plants are subsequently tested for their resistance to different pathogenic races of *Peronospora farinosa* f. sp. *spinaciae*.
21. A method for identifying a WOLF allele that confers resistance to one or more pathogenic races of *Peronospora farinosa* f. sp. *spinaciae* in a spinach plant, comprising:
    a) phenotypically selecting a spinach plant that is resistant to one or more pathogenic races of *Peronospora farinosa* f. sp. *spinaciae;*
    b) determining the sequence of the LRR domain or part thereof of a WOLF allele that is present in the genome of said spinach plant, and
    c) optionally comparing the sequence to a reference sequence representing the WOLF gene to be identified.
22. The method of paragraphs 19, 20 or 21, wherein part of a WOLF allele is amplified from the plant's genome by means of PCR.
23. A primer pair for amplifying the LRR domain or part thereof of a WOLF allele from the genome of a spinach plant, wherein the forward primer is a nucleic acid molecule comprising the sequence of SEQ ID NO:1 or SEQ ID NO:3, and the reverse primer is a nucleic acid molecule comprising the sequence of SEQ ID NO:2.

24. Use of a primer pair of paragraph 23 for identifying novel WOLF alleles as defined in paragraph 1.

25. Use of a WOLF allele or part thereof as a marker in breeding or in producing a spinach plant that is resistant to *Peronospora farinosa* f. sp. *spinaciae*.

26. An allele of an alpha-WOLF gene, wherein the protein encoded by said allele is a CC-NBS-LRR protein that comprises in its amino acid sequence: a) the motif "MAEIGYSVC" (SEQ ID NO:171) at its N-terminus; and b) the motif "KWMCLR" (SEQ ID NO:172); and wherein the LRR domain of the protein has in order of increased preference 50%, 55%, 60%, 65%, 70%, 75%, 80%, 82%, 85%, 87%, 90%, 91%, 92%, 93%, 94%, 95%, 96%, 97%, 98%, 99%, sequence similarity to any one of the amino acid sequences having SEQ ID NO:111. SEQ ID NO:113, SEQ ID NO:117, SEQ ID NO:118, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:139, SEQ ID NO: 152, SEQ ID NO:154, SEQ ID NO:162, SEQ ID NO:164, SEQ ID NO:166, SEQ ID NO:168, SEQ ID NO:170; and wherein the allele when present in a spinach plant confers resistant to one or more *Peronospora farinosa* f. sp. *spinaciae* races or isolates.

27. An allele of a beta-WOLF gene, wherein the protein encoded by said allele is a CC-NBS-LRR protein that comprises in its amino acid sequence: a) the motif "MAEIGYSVC" (SEQ ID NO:171) at its N-terminus; and b) the motif "HVGCVVDR" (SEQ ID NO:173); and wherein the LRR domain of the protein has in order of increased preference 50%, 55%, 60%, 65%, 70%, 75%, 80%, 82%, 85%, 87%, 90%, 91%, 92%, 93%, 94%, 95%, 96%, 97%, 98%, 99%, sequence similarity to any one of the amino acid sequences having SEQ ID NO:109, SEQ ID NO:115. SEQ ID NO:137; and wherein the allele when present in a spinach plant confers resistant to one or more *Peronospora farinosa* f. sp. *spinaciae* races or isolates.

28. A spinach plant comprising a WOLF allele as defined in paragraph 1, wherein the LRR domain of the WOLF allele has an amino acid sequence selected from the group consisting of SEQ ID NO:109, SEQ ID NO:111. SEQ ID NO:113, SEQ ID NO:115, SEQ ID NO:117, SEQ ID NO:118, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO: 152, SEQ ID NO:154, SEQ ID NO:162, SEQ ID NO:164, SEQ ID NO:166, SEQ ID NO:168, and SEQ ID NO:170.

29. A hybrid spinach plant comprising two WOLF alleles as defined in paragraph 1, wherein the LRR domain of the first WOLF allele and second WOLF allele each have an amino acid sequence selected from the group consisting of SEQ ID NO:109, SEQ ID NO:111. SEQ ID NO:113, SEQ ID NO:115, SEQ ID NO:117, SEQ ID NO:118, SEQ ID NO: 119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO: 152, SEQ ID NO: 154, SEQ ID NO:162, SEQ ID NO:164, SEQ ID NO:166, SEQ ID NO:168, and SEQ ID NO:170.

30. A hybrid spinach plant of paragraph 29, wherein the first and second allele are selected such that the combination of the two alleles provides resistance to races Pfs1, Pfs2, Pfs3, Pfs4, Pfs5, Pfs6, Pfs7, Pfs8, Pfs9, Pfs10, Pfs11, Pfs12, Pfs13, Pfs14, Pfs15 and Pfs16 and optionally isolate US1508.

Having thus described in detail preferred embodiments of the present invention, it is to be understood that the invention defined by the above paragraphs is not to be limited to particular details set forth in the above description as many apparent variations thereof are possible without departing from the spirit or scope of the present invention.

LENGTHY TABLES

The patent contains a lengthy table section. A copy of the table is available in electronic form from the USPTO web site (https://seqdata.uspto.gov/?pageRequest=docDetail&DocID=US11254949B2). An electronic copy of the table will also be available from the USPTO upon request and payment of the fee set forth in 37 CFR 1.19(b)(3).

SEQUENCE LISTING (175 sequences)

SEQ ID NO: 1 - DNA, 20 bp, Spinacia oleracea
  Primer
acaagtggatgtgtcttagg

SEQ ID NO: 2 - DNA, 19 bp, Spinacia oleracea
  Primer
ttcgccctcatcttcctgg

SEQ ID NO: 3 - DNA, 18 bp, Spinacia oleracea
  Primer
tcacgtgggttgtgttgt

SEQ ID NO: 4 - DNA, 6262 bp, Spinacia oleracea
atggctgaaatcggatactcggtttgttcaaaacttattgaagtgatgggcagtaagatcattaaagagatttgcgacatgtggggttacaattctcatcttgaagacctcaacaaatctgtcttgacgatcaaggatgtgctcttggatgctgaggcgaagcgggatctttcccgtgaacaacagagttacattgcagaacttaaggatgttgtttacgatgctgatgatttgttcgatgagttcctcactcttgctgagctcaaacagattgatggcaacaacaagggtggtggtaaattctccaaaaaggtacgtcgtttcttttcttctaataaggagaagatgggtcaagcttacaagatgtctcatatggttaaagaaattaagaagcagttgggtgaaattgttgataggtataccaaatttgggtttattgttgattataaacctattattaggagaagggaggaaacatgttcttattttgtaggtgccaaggagattgttgggagggataaggataaagatgttatcataggcatgttgctagatcatgataacgattgtagtttcttggctgttgtgggggttggaggggtgggaaaaactactcttgcccaacttgtgtataatgatgaaagagtcaaaagtgagttccaagatttgaggtattgggtttgtgtctctgatcaagatgggggacaatttgatgacaaaagaattctttgtaagattatagagttagttacgggccagattcctccgagtaacgagagcatggaatcggtgcgtaagaaatttcaagaggaattaggaggaaagaagtacttccttgttcttgatgatgtatggaacgaggatcgccagaagtggcttcatctagaaaatttcttgaaattgggtcaagggggaagcaagattgtggtaaccacacgttcagagaagacggcaaatgttatagggaaaagacaagactataaactagaatgtttgtcagcagaggattcatggcgcttatttgaaatgtcagcttttgacgaagggcatggccaggaaaactatgacgaattagtgacgattggcaagaagattgttgaaaaatgttataacaatccacttgctataacagtggtaggaagccttctttttggacaagagataaataagtggcggtcgtttgaaagcagtggattagcccaaattgccaatggtgataatcagattttcccgatattaaagctcagttaccacaatcttccacactccttgaagagctgctttagctattgtgcagtgtttcccaaagattatgaaataaagaaggagatgttgattgatctttggatagcacaaggatacattataccgttggatggaggtcaaagtatagaagatgctgccgaggaacattttgtaattttgttaagaagatgtttctttcaagatgtaaagaaggattctcttggtaatgttgattatgttaaaatccacgacttaatgcacgatgtcgctcaagaagtggggaaggaggaaatctgtgtagtgacttcaggtacaaagaagttggctgataaaatccgtcacgtgggttgtgttgtcgatagagatccagaaatagtctttttatgtagcaataagattcgttcgtatattagcggtcgctgcataaagaatccggtggattcacaaatagacaactggatgtgccttagggtgttggacttgtcagattcatgtgttaaagatttgtctgattcaataggtaagctgctgcacttaaggtatcttaacctctcttctaatataaagttggagataatccctgatgcaattacaagactgcataacttgcagacactacttttagaagattgcagaagtttaaaggagttgccaaaagatttttgcaaattggtcaaactgaggcacttggaattacagggttgtcatgatttgattggtatgtcatttggaatggataagctaactagtcttagaatactaccaaacattgtggtgggtaggaaggaacaaagtgttgatgatgagctgaaagccctaaaaggcctcaccgagataaaaggctccattgatatcacaatctattcaaaatatagaagagttgaaggcatgaatggcacaggaggaggagctgggtatttgaagagcatgaaacatctcacgggggttaatattacatttgatgaaggtggatgtgttaaccctgaagctgtgtatttgaagagcatgaaacatctcacgagggttattattatatttgattataaaggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatcacgcttgaagattgttacaatttgcaggagatgccagtgctgagtaaactgcctcatttgaaatcactggaacttacagagttggataacttagagtacatggagagtagaagcagcagcagtagcagtgacacagaagcagcaacaccagaattaccaacattcttcccttcccttgaaaaacttacactttggcgtctggacaagttgaagggttttgggaacaggagatcgagtagttttccccgcctctctaaattggaaatctggaaatgtccagatctaacgtcatttccttcttgtccaagccttgaagagttggaattgaaagaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatctgggttatctcaaatcactgcccacaaattgtctgactcacctcgaccttacaataagtgattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatacctgcgcatatactactgtccagccctgaaatcactaccagaagcaatgcggaacctcacctcccttcagacacttgggatatcggattgtccagacctagttaaaagatgcagaaaacccaacggcaaggactatcccaaaattcaacacatccccaaaattgtaagtcattgcagaaagtaatttattcatttatatttattttatgcttagaatgatatacgcagtcgtcctttggtttcaaatcttgaatttggtttttgttttctttctttgtttctttattcaacaccagcccatttatgattgattcattaaaaaaaggatggagttttatggatttgaagaagacaacgaattgagattcctggggttttctttttgttggggttggatttcatgtatatgttgctgattaaatacgagactgatgatgatgatgtgtttatgggttttaaatcagattaaatatatgggaaatgtaagttagttggggatgcacataaggtgtttgatgaaatgtctatgagaaatgttgtttcttggacttagaatgatatacactgtcgtcctttggtttccaatctggaatttggtttttgttttcttagtttgtttctttattccacactagcccattttttttaaactacctgcaactactgaatttcatttaccctgtatctcagattatatggtagtaattctcatttactcaacactagcttgatcctgaacgcagccaaccttcaggttagaatccgccttactcatccttttgtcatgaattgttttaagttgttttgcttgcttgtgtaatcataattcatagtatacgattcatcattcactatgtctataggcaagatattggaattgttcacgatttcctgaagtttctttgtttttgttgataccaccatattgcagcttatagtgactaagttaatgaatgtttccaaaaattagtcatataaattcttcttctctctctattacataaaccctttttctctttctaacttatcatgttcatgtctaaaacgtatacatgctcacatcattgttcgtttcagctgacttacttatgtaagagagctatctagttaacaactcttgtaactttttatttgctagtcagaacatggattggtgcaagcatgggaatatgctaacactctaccaaatcgattggagtttggacttagtttcaccagaagccatacccggacacttactggggactgtcaacaaagccgcattgtgatgtacttggatgtttcacgtgcctgaggtgcgagttacttggaagggaagcggtttatttaattgttttcccaagtagattttgcttacaagcttttacttttcacttgaaagggtttttcttgttttaagcttttcgaattagagttttcggttgcattaagagtagtcgtattagtcttttacctaaggaagactcttttttgtaattttcagactatgcaattcaagttttcgagtgttttcttgcttgtgtgattgtgagttggtgaattcgtctttcatacattttgagattatcagaagcttttatgctccaccggtagtctagtaccttttctgttactgtgcagggaagtaatctggtaccttctatatatatggaaaaacatacattatacattatgcaaaattcttacaggttagttacttcctggaacttcatttacacttagttttttttgttccattccctcggaatcaagtcattccctctgagaaatatgtaatgaacttctgtatgttgctgtttggttcctgttttaatcttcaattttcttgtatagttacagctgcatttacaatgaagtttaagcagacactctctttatatagtgcctctttctggagcaccgtagagctgtctgtggttgatcaccatctgctgccgagagattcagcaatcgcgtgtttgatcaggtaaaagtttttatgtcaatgtgtttttttttccgtttgatcaatttatgtctgtattcagattcttatcttcttacagtagcataacacattgtttctttcatttatgtaatctgtttcaagattacagagatgtatgcttcagtcgacattgatgataacttaagatggcattcctacaacagttgcaggcgcattctaactccggcaattctagttaggcaagaggagcattgccaatacctgccacctctgggatttactataccagggttgaagtttatggaagacaccagctatgcacaagccttcaaggggtcatcctacataacaagttgaaccaaccaattgcttgttggttcagtggtaattggagctgaatttggtagggatgacccgtgttcgatccccacaacaacaattgggaggggactggaacctatccacacagaactcgccctgaatccggattagccctaagggtgaacggggtgctaacaccaaaaaaaaaaacataacaagttgaaccaaacatactttgtttgaattgaagatttagtgatttcatttgatcgattgagatgtcttattataagcgtatatgctcttggatttggccacttaggtgttgtttgacaattggtcattaactcgcttttatattttcttttctcttaggaaaggtgatcctgagaatttatattggaacactttttttttctcactagctttaaaaaagtgttctgtgttacctgcaattcaatttgattatttttcacatagttttacctgaaaaagtgttacctgaaaaagtgttacctgaaaatcaactgacataagtttttgtttggatccaattaaggacactagataaatcggaataaataatcaaccaattaagtacttcataattaaatatgaagtgtat

SEQ ID NO: 5 - DNA, 2000 bp, Spinacia oleracea
tctttggttttttggtccacaactccacactaagaggaactccaatgcttagttacaaggtggtgtagttaaaaagtaactccaatagttaactacacggtattatagttaaatttgccaactcaaatttctaactacaatatatttaagctacaaagtttctcattggctgactacaatacgttgtagcgccttataatattttattcaatatacaattttatttattttacctttttaacaattttttttgatctacctgctgtcctgttcatatgagctacactaatttgatagctgcttacgcaattcttatatcaacggttggctacttgttcaaatatttttatttttttacgagtaagtcattttatgatcattgaagtggctctattattattatcatgcaccgattaacgcaagaataattaactcggtacgaattagtttcaaaataaaatccctcaaaaaaaaaagtttcaaaataaaattaacagaaaaccaaccttctccggtttactgttgttagagcatggaattttccagtaatcgcagaccccaaattatcttccagttgaatcaatccttgatttttggatttgccagaaaactccttgaattttagggttcatatttgatccgtaattgggaaaattttcagcaattgatcttccaaatcagccctacttgtttccagactgcaaatgaaaggtgcgaactttatactgcattttggttttccattagtgtaatttagtgtaatttattaagataaactgcattttgcaattgttttattcgactactcatttttaaatcaaattgcttaattgctagttagttttcttatcatattgccaaaaaaaattatttttgtttaactggtgaaaaagggtaaattataccactgttaatttgttgacacatcatcaaacgtactgaaaaatgagaatgaaagacaataaatatgttattttaaccaatagaaaaacatgatgagtaagatccttaattgatagataaataattaaatatcagtccattagttgaatattcaatgaaaatgtatggtccaaaaatggcgtttaatagtcaatgtcatgctttatggggtggtggagtactatgtgactgtgtgtggacttggagaagactagagagtatgattatcaacatatagaccctgaaaatgaaaatgaaaatgaaaatgatgtttttacactttaaaatcgtcaagaaacaacaatcctttttagcaatagtatttacacgcgctagttgcacgaactttaatgcaaatagtataaatttacggtcaaagttttcatactttagacacatactctctccgtcccttaatactcgcaccgctttccttttcgggccgtcccttaatacttgcaccgcttctataaatggaaatctatttctcacaattacctactaacccacctacactcatcgtccctacaaaaaatcatttaaaaattcacaccccacactcaccactcctcacccattacacatttcctactaactatattaaaaaaatatcccactataaactaacactcattaaattaataagtcaattcaaatatcttaaactccgcaccggtcaaatcggtgcgagtattaagggacggagggagtattatagagtgtaaataactttcatgaatggagggagtaaaaaattgttttacttggctaaaatacttttgttcttattggcagataaacatgagtccattattggccaacttgaacatatacctccaaacaataatcaataatgtcgattatgaagtttgtgaatgcaatttattatcactttcattgcaagttgtcatctgtgctgagtgttgatttataaaaaggactacttgattaacacatacaatattactccacctttctccagacaacctttcttttctgcttttatcttgttttctcatcttaattcatctcttcatctttctgaaaaacccaaccca

SEQ ID NO: 6 - DNA, 3543 bp, Spinacia oleracea
atggctgaaatcggatactcggtttgttcaaaacttattgaagtgatgggcagtaagatcattaaagagatttgcgacatgtggggttacaattctcatcttgaagacctcaacaaatctgtcttgacgatcaaggatgtgctcttggatgctgaggcgaagcgggatctttcccgtgaacaacagagttacattgcagaacttaaggatgttgtttacgatgctgatgatttgttcgatgagttcctcactcttgctgagctcaaacagattgatggcaacaacaagggtggtggtaaattctccaaaaaggtacgtcgtttcttttcttctaataaggagaagatgggtcaagcttacaagatgtctcatatggttaaagaaattaagaagcagttgggtgaaattgttgataggtataccaaatttgggtttattgttgattataaacctattattaggagaagggaggaaacatgttcttattttgtaggtgccaaggagattgttgggagggataaggataaagatgttatcataggcatgttgctagatcatgataacgattgtagtttcttggctgttgtgggggttggaggggtgggaaaaactactcttgcccaacttgtgtataatgatgaaagagtcaaaagtgagttccaagatttgaggtattgggtttgtgtctctgatcaagatgggggacaatttgatgacaaaagaattctttgtaagattatagagttagttacgggccagattcctccgagtaacgagagcatggaatcggtgcgtaagaaatttcaagaggaattaggaggaaagaagtacttccttgttcttgatgatgtatggaacgaggatcgccagaagtggcttcatctagaaaatttcttgaaattgggtcaagggggaagcaagattgtggtaaccacacgttcagagaagacggcaaatgttatagggaaaagacaagactataaactagaatgtttgtcagcagaggattcatggcgcttatttgaaatgtcagcttttgacgaagggcatggccaggaaaactatgacgaattagtgacgattggcaagaagattgttgaaaaatgttataacaatccacttgctataacagtggtaggaagccttctttttggacaagagataaataagtggcggtcgtttgaaagcagtggattagcccaaattgccaatggtgataatcagattttcccgatattaaagctcagttaccacaatcttccacactccttgaagagctgctttagctattgtgcagtgtttcccaaagattatgaaataaagaaggagatgttgattgatctttggatagcacaaggatacattataccgttggatggaggtcaaagtatagaagatgctgccgaggaacattttgtaattttgttaagaagatgtttctttcaagatgtaaagaaggattctcttggtaatgttgattatgttaaaatccacgacttaatgcacgatgtcgctcaagaagtggggaaggaggaaatctgtgtagtgacttcaggtacaaagaagttggctgataaaatccgtcacgtgggttgtgttgtcgatagagatccagaaatagtctttttatgtagcaataagattcgttcgtatattagcggtcgctgcataaagaatccggtggattcacaaatagacaactggatgtgccttagggtgttggacttgtcagattcatgtgttaaagatttgtctgattcaataggtaagctgctgcacttaaggtatcttaacctctcttctaatataaagttggagataatccctgatgcaattacaagactgcataacttgcagacactacttttagaagattgcagaagtttaaaggagttgccaaaagatttttgcaaattggtcaaactgaggcacttggaattacagggttgtcatgatttgattggtatgtcatttggaatggataagctaactagtcttagaatactaccaaacattgtggtgggtaggaaggaacaaagtgttgatgatgagctgaaagccctaaaaggcctcaccgagataaaaggctccattgatatcacaatctattcaaaatatagaagagttgaaggcatgaatggcacaggaggaggagctgggtatttgaagagcatgaaacatctcacgggggttaatattacatttgatgaaggtggatgtgttaaccctgaagctgtgtatttgaagagcatgaaacatctcacgagggttattattatatttgattataaaggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatcacgcttgaagattgttacaatttgcaggagatgccagtgctgagtaaactgcctcatttgaaatcactggaacttacagagttggataacttagagtacatggagagtagaagcagcagcagtagcagtgacacagaagcagcaacaccagaattaccaacattcttcccttcccttgaaaaacttacactttggcgtctggacaagttgaagggttttgggaacaggagatcgagtagttttccccgcctctctaaattggaaatctggaaatgtccagatctaacgtcatttccttcttgtccaagccttgaagagttggaattgaaagaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatctgggttatctcaaatcactgcccacaaattgtctgactcacctcgaccttacaataagtgattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatacctgcgcatatactactgtccagccctgaaatcactaccagaagcaatgcggaacctcacctcccttcagacacttgggatatcggattgtccagacctagttaaaagatgcagaaaacccaacggcaaggactatcccaaaattcaacacatccccaaaattattatatggtag

SEQ ID NO: 7 - protein, 1180 aa, Spinacia oleracea
MAEIGYSVCSKLIEVMGSKIIKEICDMWGYNSHLEDLNKSVLTIKDVLLDAEAKRDLSREQQSYIAELKDVVYDADDLFDEFLTLAELKQIDGNNKGGGKFSKKVRRFFSSNKEKMGQAYKMSHMVKEIKKQLGEIVDRYTKFGFIVDYKPIIRRREETCSYFVGAKEIVGRDKDKDVIIGMLLDHDNDCSFLAVVGVGGVGKTTLAQLVYNDERVKSEFQDLRYWVCVSDQDGGQFDDKRILCKIIELVTGQIPPSNESMESVRKKFQEELGGKKYFLVLDDVWNEDRQKWLHLENFLKLGQGGSKIVVTTRSEKTANVIGKRQDYKLECLSAEDSWRLFEMSAFDEGHGQENYDELVTIGKKIVEKCYNNPLAITVVGSLLFGQEINKWRSFESSGLAQIANGDNQIFPILKLSYHNLPHSLKSCFSYCAVFPKDYEIKKEMLIDLWIAQGYIIPLDGGQSIEDAAEEHFVILLRRCFFQDVKKDSLGNVDYVKIHDLMHDVAQEVGKEEICVVTSGTKKLADKIRHVGCVVDRDPEIVFLCSNKIRSYISGRCIKNPVDSQIDNWMCLRVLDLSDSCVKDLSDSIGKLLHLRYLNLSSNIKLEIIPDAITRLHNLQTLLLEDCRSLKELPKDFCKLVKLRHLELQGCHDLIGMSFGMDKLTSLRILPNIVVGRKEQSVDDELKALKGLTEIKGSIDITIYSKYRRVEGMNGTGGGAGYLKSMKHLTGVNITFDEGGCVNPEAVYLKSMKHLTRVIIIFDYKGGCVNPEAVLATLEPPSNIKRLEMWHYSGTTIPVWGRAEINWAISLSHLVDITLEDCYNLQEMPVLSKLPHLKSLELTELDNLEYMESRSSSSSSDTEAATPELPTFFPSLEKLTLWRLDKLKGFGNRRSSSFPRLSKLEIWKCPDLTSFPSCPSLEELELKENNEALQIIVKITTTRGKEEKEEDKNAGVGNSQDDDNVKLWKVEIDNLGYLKSLPTNCLTHLDLTISDSKEGEGEWEVGDAFQKCVSSLRSLTIIGNHGINKVKRLSGRTGLEHFTLLESLKLSDIEDQEDEGEDNIIFWKSFPQNLRSLRIKDSDKMTSLPMGMQYLTSLQTLYLHHCYELNSLPEWISSLSSLQYLRIYYCPALKSLPEAMRNLTSLQTLGISDCPDLVKRCRKPNGKDYPKIQHIPKIIIW

SEQ ID NO: 8 - DNA, 6953 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgccgagtttatacctgtttgtagggaaagggggaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccgcacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgcttcagttattgtgcagtgtttcccaaggatcatgaaataaagaaggagatgttgattgatctttggatagcacaaggatacgttgtggcacttgatggaggtcaaagtatagaagatgctgccgaagaacattttgtaattttgttacggagatgtttctttcaagatgtaaagaaggatgaatatggtgatgttgattctgttaaaatccacgacttgatgcacgatgtcgcccaagaagtggggagggaggaaatatgtgtagtgaatgataatacaaagaacttgggtgataaaatccgtcatgtacatggtgatgtcaatagatatgcacaaagagtctctctgtgtagccatagccataagattcgttcgtatattggtggtgattgtgaaaaacgttgtgtggatacactaatagacaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactacttttagaagattgcagaagtttaaaggagttgccaaaagatttttgcaaattggtcaaactgaggcacttggaattacagggttgtcatgatttgattggtatgccatttggaatggataagctaactagtcttagaatactaccaaacattgtggtgggtaggaaggaacaaagtgatgatgagctgaaagccctaaaaggcctcaccgagataaaaggctccatttctatcagaatctattcaaagtatagaatagttgaaggcatgaatgacacaggaggagctgcttatttgaagagcatgaaacatctcagggagattgatattacatttttgggtgaatgtgttggccctgaagctgtattggaaaccttagagccaccttcaaatatcaagagcttatatatatataattacagtggtacaacaattccagtatggggaagagcagagattaattgggcaatctccctctcacatctcgtcgacatccagcttagttgttgtagtaatttgcaggagatgccagtgctgagtaaactgcctcatttgaaatcgctgaaacttggatggttggataacttagagtacatggagagtagcagtagcagtgacacagaagcagcaacaccagaattaccaacattcttcccttcccttgaaaaacttactttacagcatctggaaaagttgaagggttttgggaacaggagatcgagtagttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggggtctggaaaagttgaagggtttggggaacaggagatcgagtagttttccccgcctctctgaattgaaaatcatggaatgcccagatctaacgtggtttcctccctgtccaagccttgaaaaacttacactttggcgtctggacaagttgaagggttttgggaaccggagatcgagtacttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcaaatcactgcccacaaattgtcttactcacctcgaccttacaataagtgattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttggaaattgaaaactcttacaaaatgacaagtttgcccatggggatgcagtacttaacctccctccaaaccctctatctacaccattgttatgaattgaattcccttccagaatggataagcagcttatcatctcttcaatacctgcgcatatactactgtccagccctgaaatcactaccagaagcaatgcggaacctcacctcccttcagacacttgggatatcggattgtccagacctagttaaaagatgcagaaaacccaacggcaaggactatcccaaaattcaacacatccccaaaattgtaagtcattgcagaaagtaatttattcatttatatttattttatgcttagaatgatatacaccgtcgtcctttggtttcaaatcttgaatttggtttttgttttctttctttgtttctttattcaacaccagcccatttatgattgattcattaaaaaaaggatggagttttatggatttgaagaagacaacgaattgagattcctggggttttctttttgttggggttggatttcatgtatatgttgctgattaaatacgagactgatgatgatgatgtgtttatgggttttaaatcagattaaatatatgggaaatgtaagttagttggggatgcacataaggtgtttgatgaaatgtctatgagaaatgttgtttcttggacttagaatgatatacactgtcgtcctttggtttccaatctggaatttggtttttgttttcttagtttgtttctttattccacactagcccattttttttaaactacctgcaactactgaatttcatttaccctgtatctcagattatatggtagtaattctcatttactcaacactagcttgatcctgaacgcagccaaccttcaggttagaatccgccttactcatccttttgtcatgaattgttttaagttgttttgcttgcttgtgtaatcataattcatagtatacgattcatcattcactatgtctataggcaagatattggaattgttcacgatttcctgaagtttctttgtttttgttgataccaccatattgcagcttatagtgactaagttaatgaatgtttccaaaaattagtcatataaattcttcttctctctctattacataaaccctttttctctttctaacttatcatgttcatgtctaaaacgtatacatgctcacatcattgttcgtttcagctgacttacttatgtaagagagctatctagttaacaactcttgtaactttttatttgctagtcagaacatggattggtgcaagcatgggaatatgctaacactctaccaaatcgattggagtttggacttagtttcaccagaagccatacccggacacttactggggactgtcaacaaagccgcattgtgatgtacttggatgtttcacgtgcctgaggtgcgagttacttggaagggaagcggtttatttaattgttttcccaagtagattttgcttacaagcttttacttttcacttgaaagggtttttcttgttttaagcttttcgaattagagttttcggttgcattaagagtagtcgtattagtcttttacctaaggaagactcttttttgtaattttcagactatgcaattcaagttttcgagtgttttcttgcttgtgtgattgtgagttggtgaattcgtctttcatacattttgagattatcagaagcttttatgctccaccggtagtctagtaccttttctgttactgtgcagggaagtaatctggtaccttctatatatatggaaaaacatacattatacattatgcaaaattcttacaggttagttacttcctggaacttcatttacacttagttttttttgttccattccctcggaatcaagtcattccctctgagaaatatgtaatgaacttctgtatgttgctgtttggttcctgttttaatcttcaattttcttgtatagttacagctgcatttacaatgaagtttaagcagacactctctttatatagtgcctctttctggagcaccgtagagctgtctgtggttgatcaccatctgctgccgagagattcagcaatcgcgtgtttgatcaggtaaaagtttttatgtcaatgtgtttttttttccgtttgatcaatttatgtctgtattcagattcttatcttcttacagtagcataacacattgtttctttcatttatgtaatctgtttcaagattacagagatgtatgcttcagtcgacattgatgataacttaagatggcattcctacaacagttgcaggcgcattctaactccggcaattctagttaggcaagaggagcattgccaatacctgccacctctgggatttactataccagggttgaagtttatggaagacaccagctatgcacaagccttcaaggggtcatcctacataacaagttgaaccaaccaattgcttgttggttcagtggtaattggagctgaatttggtagggatgacccgtgttcgatccccacaacaacaattgggaggggactggaacctatccacacagaactcgccctgaatccggattagccctaagggtgaacggggtgctaacaccaaaaaaaaaaacataacaagttgaaccaaacatactttgtttgaattgaagatttagtgatttcatttgatcgattgagatgtcttattataagcgtatatgctcttggatttggccacttaggtgttgtttgacaattggtcattaactcgcttttatattttcttttctcttaggaaaggtgatcctgagaatttatattggaacactttttttttctcactagctttaaaaaagtgttctgtgttacctgcaattcaatttgattatttttcacatagttttacctgaaaaagtgttacctgaaaaagtgttacctgaaaatcaactgacataagtttttgtttggatccaattaaggacactagataaatcggaataaataatcaaccaattaagtacttcataattaaatatgaag

SEQ ID NO: 9 - DNA, 2000 bp, Spinacia oleracea
tttgaagttaggcttaacttgctcaccaattcttaaatagactcgacttacactgaatttattgtgtactatgtctagaaagtaaggtcaacaactttcttctaaattattttggcatgtttattagggttattatgaaaaacatatcaaattggtgttgttagttaggcttgaataatatgattttaagtcacgagacttttataaattaggtaatttgatttaaaaaattgttacatatctaagaaaatggatgttaaatttatcagtcaatgtataaacaataaaagtcaatatgtatgtaaaagggttgctagataaaatctttggttttttggtccacaactccacactaagaggaactccaatgcttagttacaaggtggtgtagttaaaaagtaactccaatagttaactacacggtattatagttaaatttgccaactcaaatttctaactacaatatatttaagctacaaagtttctcattggctgactacaatacgttgtagcgccttataatattttattcaatatacaattttatttattttacctttttaacaatttttttttgatctacctgctgtcctgttcatatgagctacactaatttgatagctgcttacgcaattcttatatcaacggttggctacttgttcaaatatttttatttttttacgagtaagtcattttatgatcattgaagtggctctattattattatcatgcaccgattaacgcaagaataattaactcggtacgaattagtttcaaaataaaatccctcaaaaaaaaaagtttcaaaataaaattaacagaaaaccaaccttctccggtttactgttgttagagcatggaattttccagtaatcgcagaccccaaattatcttccagttgaatcaatccttgatttttggatttgccagaaaactccttgaattttagggttcatatttgatccgtaattgggaaaattttcagcaattgatcttccaaatcagccctacttgtttccagactgcaaatgaaaggtgcgaactttatactgcattttggttttccattagtgtaatttattaagatgaactgcattttgcaattgttttattcgactactcatttttaaatcaaattgcttaattgctagttagttttcttatcatattgccaaaaaaaattatttttgtttaattggtgaaaaagggtaaattatacctagtgtacaagattttcttgcacaccaccgttaatttgttgacacatcatcaaacgtactgaaaaatgagaatgaaagacaataaatatgtcattttaaccaatagaaaaacatgatgtagtaagatccttaattgatagataaataattaaatatcagtccattagttgaatattcaatgaaaatgtatggtccaaaaatggcgtttaatagtcaatgtcatgctttatggggtggtggagtactatgtgactgtgtgtggacttggagaagactagagagtatgattatcaacctatggaccctcaaaatgaaaatgaaaatgatgtttacacgtgctatttgcacggacttcaatgcaaatagtataaatttacggtcaaagttttcattctaaagcgtaaataactttcatgattggaggacggtagtataagtataacgttatagcctaccattttcttatcatattcacataaatttgttgctgaaatttgttttacttggctaaaatacttttgttcttattggcagataaacatcagtacgtccattattggccaacttgctgagtccattattggccaacttgaacatatacctccaaacaataatcaataatgtcgattatgaagtttgtgaatgcaatttattatcactttcatttataaaatgactacttgattaacacatacaatattacctttctccaaacaccctttcaattctgcttaatcttgttttctcatcatctcttcatctttctgaaaacacaaccca

SEQ ID NO: 10 - DNA, 4239 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgccgagtttatacctgtttgtagggaaagggggaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccgcacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgcttcagttattgtgcagtgtttcccaaggatcatgaaataaagaaggagatgttgattgatctttggatagcacaaggatacgttgtggcacttgatggaggtcaaagtatagaagatgctgccgaagaacattttgtaattttgttacggagatgtttctttcaagatgtaaagaaggatgaatatggtgatgttgattctgttaaaatccacgacttgatgcacgatgtcgcccaagaagtggggagggaggaaatatgtgtagtgaatgataatacaaagaacttgggtgataaaatccgtcatgtacatggtgatgtcaatagatatgcacaaagagtctctctgtgtagccatagccataagattcgttcgtatattggtggtgattgtgaaaaacgttgtgtggatacactaatagacaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactacttttagaagattgcagaagtttaaaggagttgccaaaagatttttgcaaattggtcaaactgaggcacttggaattacagggttgtcatgatttgattggtatgccatttggaatggataagctaactagtcttagaatactaccaaacattgtggtgggtaggaaggaacaaagtgatgatgagctgaaagccctaaaaggcctcaccgagataaaaggctccatttctatcagaatctattcaaagtatagaatagttgaaggcatgaatgacacaggaggagctgcttatttgaagagcatgaaacatctcagggagattgatattacatttttgggtgaatgtgttggccctgaagctgtattggaaaccttagagccaccttcaaatatcaagagcttatatatatataattacagtggtacaacaattccagtatggggaagagcagagattaattgggcaatctccctctcacatctcgtcgacatccagcttagttgttgtagtaatttgcaggagatgccagtgctgagtaaactgcctcatttgaaatcgctgaaacttggatggttggataacttagagtacatggagagtagcagtagcagtgacacagaagcagcaacaccagaattaccaacattcttcccttcccttgaaaaacttactttacagcatctggaaaagttgaagggttttgggaacaggagatcgagtagttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggggtctggaaaagttgaagggtttggggaacaggagatcgagtagttttccccgcctctctgaattgaaaatcatggaatgcccagatctaacgtggtttcctccctgtccaagccttgaaaaacttacactttggcgtctggacaagttgaagggttttgggaaccggagatcgagtacttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcaaatcactgcccacaaattgtcttactcacctcgaccttacaataagtgattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttggaaattgaaaactcttacaaaatgacaagtttgcccatggggatgcagtacttaacctccctccaaaccctctatctacaccattgttatgaattgaattcccttccagaatggataagcagcttatcatctcttcaatacctgcgcatatactactgtccagccctgaaatcactaccagaagcaatgcggaacctcacctcccttcagacacttgggatatcggattgtccagacctagttaaaagatgcagaaaacccaacggcaaggactatcccaaaattcaacacatccccaaaattattatatggtag

SEQ ID NO: 11 - protein, 1412 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRERGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTARSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIDLWIAQGYVVALDGGQSIEDAAEEHFVILLRRCFFQDVKKDEYGDVDSVKIHDLMHDVAQEVGREEICVVNDNTKNLGDKIRHVHGDVNRYAQRVSLCSHSHKIRSYIGGDCEKRCVDTLIDKWMCLRMLDLSWSDVKNLPNSIGKLLHLRYLNLSDNRNLKILPDAITRLHNLQTLLLEDCRSLKELPKDFCKLVKLRHLELQGCHDLIGMPFGMDKLTSLRILPNIVVGRKEQSDDELKALKGLTEIKGSISIRIYSKYRIVEGMNDTGGAAYLKSMKHLREIDITFLGECVGPEAVLETLEPPSNIKSLYIYNYSGTTIPVWGRAEINWAISLSHLVDIQLSCCSNLQEMPVLSKLPHLKSLKLGWLDNLEYMESSSSSDTEAATPELPTFFPSLEKLTLQHLEKLKGFGNRRSSSFPRLSELEIKKCPDLTSFPSCPSLEKLELKESNEALQIIVKITTRGKEKEENNNAGVRNSQDDDKVKLRKMVIDNLGYLTGVDIRFDDREGGFVNPEAVLATLEPPSNIKSLSIHRFDGKTLPVWGRAEINWAISLSHLVDIQLWHCRNLQEMPVLSKLPHLKSLELYNLISLEYMESTSRSSSSDTEAATPELPTFFPSLEKLTLWGLEKLKGLGNRRSSSFPRLSELKIMECPDLTWFPPCPSLEKLTLWRLDKLKGFGNRRSSTFPRLSELEIKKCPDLTSFPSCPSLEKLELKESNEALQIIVKITTRGKEKEENNNAGVRNSQDDDKVKLRKMVIDNLGYLKSLPTNCLTHLDLTISDSKEGEGEWEVGDAFQKCVSSLRSLTIIGNHGINKVKRLSGRTGLEHFTLLESLKLSDIEDQEDEGEDNIIFWKSFPQNLRSLEIENSYKMTSLPMGMQYLTSLQTLYLHHCYELNSLPEWISSLSSLQYLRIYYCPALKSLPEAMRNLTSLQTLGISDCPDLVKRCRKPNGKDYPKIQHIPKIIIW

SEQ ID NO: 12 - DNA, 6248 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccacacgttcagagaagacagcaaatgtcatagggaaaagacatttttatacactggaatgtttgtcgccagattattcatggagcttatttgaaatgtcggcttttcagaaagggcatgagcaggaaaaccatgacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgtcgatattgaagctcagttactacaatcttgcaaactctttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaaatatgtgtagtgaatgataatacaaagaacttgggtgataaaatccgtcatgtacatggtgatgtcaatagatatgcacaaagagtctctctgtgtagccataagattcgttcgtatattggtggtaaatgtgaaaaacgttgggtggatacactaatagacaagtggatgtgtcttaggatgttggacttgtcaaggtcggatgttaaaaatttgcctaattcaataggtaaattgttgcacttgaggtgtcttaacctgtcttataatgatctgttgatactccctgatgcaattacaagactgcataatttgcagacactgcttttaaaagattgcggaagtttaatggagttgccaaaagatttttgcaaattggtcaaactgagacacttggatttaagggattgtgatgatttgattggtatgccattgggaatggataggctaactagtcttagagtactgccattctttgtggtgggtaggaaggaacaaagtgttgacgatgagctgaaagccctaaaaggcctcaccgagataaaaggctccattgatatcacaatctattcaaagtatagaatagttgaaggcatgaatgacacaggagctgggtatttgaagagcatgaaacatctcagggagattggtattacatttgatggtggatgtgttaaccctgaagctgtgttggaaaccctagagccaccttcaaatatcaagagcttatctatagataattacgatggtacaacaattccagtatggggaagagcagagattaattgggcaatctccctctcacatcttgtcgacatttggttttgtggttgtagtaatttgcaggagatgccagtgctgagtaaactgcctcatttgaaatcactgtatctttttatgttttgtaagttagagtacatggagagtagaagcagcagcagtagcagtgacacagaagcagcaacaccagaattaccaacattcttcccttcccttgaaaaacttacactttggtatctggaaaagttgaagggtttggggaacaggagatcgagtagttttccccgcctctctaaattggaaatcaatgaatgcccagatctaacgtggtttcctccttgtccaagccttgaaacgttgaaattggtaaaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatcaatgttatctcaaatcactgcccacaaattgtcttactcacctcaacataaaagtaagagattccgaaggggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcaaattttcatatatagaagaccaggaagatgagggcgaagacaacatcatattctggaaatcctttcctcaaaacctccgcagtttggaaattaaaggctcttgcaaaatgacaagtttgcccatggggatgcagtacttaacctccctccaaaccctccatctatcatattgtgatgaattgaattcccttccagaatggataagcagcttatcatctcttcaatccctgttcatatacaattgtccagccctgaaatcactaccagaagcaatgaagaacctcacctcccttcagagacttgagatacagcattgtccagacctagctgaaagatgcagaaaacccaacggggaggactatcccaaaattcaacacatccccaaaattgtaagtcattgcagaaagtaatttattcatttatatttattttatgcttagaatgatatacgcagtcgtcctttggtttccaatcttgaatttggtttttgttttctttctttgtttctttattcaacaccagtccatttatgattgattcattaaaaaaaggatggagttttatggatttgaagaagacaacgaattgagattcctggggttttttttttcgttggggttggttttcatgtatatgttgctgattaaataccagactgatgatgatgatgtgtttatgggttttaaatcagattaaatatatgggaaatgtaagttaattggggatgcacataaggtgtttgatgaaatgtctatgagaaatgttgtttcttggacttagaatgatatacactgtcgtcctttggtttccaatcttacatttggtttgtgttttcttagtttgtttctttaatcaacaccagcccattttttttaaactacctgcaactactaattttcatttaccctgtatctcaggaaatatggtagtaattctcatttactcaacactagcttgatcctgaacgcagccaaccttcaggttagaatccgccttactcatccttttgtcatgcattgttttaagttgttttgcttgcttgtgtaatcataattcatagtatacgattcatcattcactatgtctacaggcaagatattggaattgttcacgattccctgaagtttctttgtttttgttgataccaccatattgcagcttatagtgactaagttaatgaatgtttccaaaaaattagtcatataaattcttcttctctctctattacataaactctttttctctttctaacttatcatgttcatgcctaaaacttatacatgctcacatcattgttcgtttgagctgacttacttctgtaagagagctatctagttaacaactcttgtaactttttatttgctagtcagaacatggattggtgcaagcatgggaatttgctaacactctaccaaatcgattggagtttagacttagtttcaccagaagccatacccggacacttactggggactgtcaacaaagccgcattgtgatgtacttggatgtttcacgtgcctgaggtgcgagttacttggaagggaagcggtttatttaattgttttccgaagtagattttgcttacaagcttttacttttcccttgaaagggtttttcttgttttaagcttttcgaattagagtttcggttgcattaagagtagtcgtattagtcttttttacctaagactcttttttgtaattttcagactatgcaattcaagttttcgagtgttttcttgcttgtgtgattgtgagttggtgaattcgtctttcatacattttgagattatcagaagctttatgctccaccggtagtctagtaccttttctgttactgtacgtgcagggaagtaatctggtaccttctatatatatggaaaaacatacattatacattatgcaaaattcttacaggttagttacttcctggaacttcatttacactttgttttttttgttccattccctcggaagactattccctctgagaaatatgtaatgaacttctgtatgttgctgtttggttcctgttttaatcttcaattttcttgtatagttacagctgcatttacaatgaagtttaagcagacactctctttatatagtgcttctttctggagcaccgtagagctgtctgtggttgatcaccatctgctgccgagagattcagcaatcgcatgtttgatcaggtaaaagtttttatgtcaatgtgtttttttttccgtttgatcaatttatgtctgtattcagattcttatcttcttatagtagcataacacattgtttctttcatttatgtaaactgtttcaagattacagagatgtatgcttcagtcgacattgatgataacttaagatggcattcctacaacagttgcaggcgcattctaactccggcaattctagttaggcaagaggagcattgccaatacctgccacctctgggatttactataccagggttgaagtttatggaagacaccagctatgcacaagccttcaaggggtcatcctacataacaagttgaaccaaccaattgcttgttggtttagtggtaattggagctgaatttggtagggatggcccgtgttcgatccccacaacaacaattgggaggggactggaacctatccacacagaactcgccctgaatccggattagtcctaagggtgaacggggtgctaacaccaaaaaaaaaaacataacaagttgaaccaaacatactttgtttgaattgaagatttagtgatttcatttgatcgattgagatgtcttattataagcgtatatgctcttggatttggccacttaggtgttgtttgacaattggtcattaactcgcttttatattttcttttctcttaggaaaggtgatcctgataatttatattggaacactttttttttctctcactagctttaaaaaagtgttctgtgttacctgcaattcaatttgattatttttcacatagttttacctgaaaaagtgttacctgaaaatcaactgacataagtttttgtttggatccaattaaggacactagataaaccggaataaataatcaaccaattaagtacttcataattaaatatgaagtgtattattatcttatgcttgtgacattgaaggatgttatgatattttaactcaataccttgcaaaatatactggttaaatttcttaacaaggtaacttggcaa

SEQ ID NO: 13 - DNA, 2000 bp, Spinacia oleracea
tttgaagttaggcttaacttgctcaccaattcttaaatagactcgacttacactgaatttattgtgtactatgtctagaaagtaaggtcaacaactttcttctaaattattttggcatgtttattagggttattatgaaaaacatatcaaattggtgttgttagttaggcttgaataatatgattttaagtcacgagacttttataaattaggtaatttgatttaaaaaattgttacatatctaagaaaatggatgttaaatttatcagtcaatgtataaacaataaaagtcaatatgtatgtaaaagggttgctagataaaatctttggttttttggtccacaactccacactaagaggaactccaatgcttagttacaaggtggtgtagttaaaaagtaactccaatagttaactacacggtattatagttaaatttgccaactcaaatttctaactacaatatatttaagctacaaagtttctcattggctgactacaatacgttgtagcgccttataatattttattcaatatacaattttatttattttacctttttaacaatttttttttgatctacctgctgtcctgttcatatgagctacactaatttgatagctgcttacgcaattcttatatcaacggttggctacttgttcaaatatttttatttttttacgagtaagtcattttatgatcattgaagtggctctattattattatcatgcaccgattaacgcaagaataattaactcggtacgaattagtttcaaaataaaatccctcaaaaaaaaaagtttcaaaataaaattaacagaaaaccaaccttctccggtttactgttgttagagcatggaattttccagtaatcgcagaccccaaattatcttccagttgaatcaatccttgatttttggatttgccagaaaactccttgaattttagggttcatatttgatccgtaattgggaaaattttcagcaattgatcttccaaatcagccctacttgtttccagactgcaaatgaaaggtgcgaactttatactgcattttggttttccattagtgtaatttattaagatgaactgcattttgcaattgttttattcgactactcatttttaaatcaaattgcttaattgctagttagttttcttatcatattgccaaaaaaaattatttttgtttaattggtgaaaaagggtaaattatacctagtgtacaagattttcttgcacaccaccgttaatttgttgacacatcatcaaacgtactgaaaaatgagaatgaaagacaataaatatgtcattttaaccaatagaaaaacatgatgtagtaagatccttaattgatagataaataattaaatatcagtccattagttgaatattcaatgaaaatgtatggtccaaaaatggcgtttaatagtcaatgtcatgctttatggggtggtggagtactatgtgactgtgtgtggacttggagaagactagagagtatgattatcaacctatggaccctcaaaatgaaaatgaaaatgatgtttacacgtgctatttgcacggacttcaatgcaaatagtataaatttacggtcaaagttttcattctaaagcgtaaataactttcatgaatggaggacggtagtataagtataacgttatagcctaccattttcttatcatattcacataaatttgttgctgaaatttgttttacttggctaaaatacttttgttcttattggcagataaacatcagtacgtccattattggccaacttgctgagtccattattggccaacttgaacatatacctccaaacaataatcaataatgtcgattatgaagtttgtgaatgcaatttattatcactttcatttataaaatgactacttgattaacacatacaatattacctttctccaaacaccctttcaattctgcttaatcttgttttctcatcatctcttcatctttctgaaaacacaaccca

SEQ ID NO: 14 - DNA, 3444 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccacacgttcagagaagacagcaaatgtcatagggaaaagacatttttatacactggaatgtttgtcgccagattattcatggagcttatttgaaatgtcggcttttcagaaagggcatgagcaggaaaaccatgacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgtcgatattgaagctcagttactacaatcttgcaaactctttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaaatatgtgtagtgaatgataatacaaagaacttgggtgataaaatccgtcatgtacatggtgatgtcaatagatatgcacaaagagtctctctgtgtagccataagattcgttcgtatattggtggtaaatgtgaaaaacgttgggtggatacactaatagacaagtggatgtgtcttaggatgttggacttgtcaaggtcggatgttaaaaatttgcctaattcaataggtaaattgttgcacttgaggtgtcttaacctgtcttataatgatctgttgatactccctgatgcaattacaagactgcataatttgcagacactgcttttaaaagattgcggaagtttaatggagttgccaaaagatttttgcaaattggtcaaactgagacacttggatttaagggattgtgatgatttgattggtatgccattgggaatggataggctaactagtcttagagtactgccattctttgtggtgggtaggaaggaacaaagtgttgacgatgagctgaaagccctaaaaggcctcaccgagataaaaggctccattgatatcacaatctattcaaagtatagaatagttgaaggcatgaatgacacaggagctgggtatttgaagagcatgaaacatctcagggagattggtattacatttgatggtggatgtgttaaccctgaagctgtgttggaaaccctagagccaccttcaaatatcaagagcttatctatagataattacgatggtacaacaattccagtatggggaagagcagagattaattgggcaatctccctctcacatcttgtcgacatttggttttgtggttgtagtaatttgcaggagatgccagtgctgagtaaactgcctcatttgaaatcactgtatctttttatgttttgtaagttagagtacatggagagtagaagcagcagcagtagcagtgacacagaagcagcaacaccagaattaccaacattcttcccttcccttgaaaaacttacactttggtatctggaaaagttgaagggtttggggaacaggagatcgagtagttttccccgcctctctaaattggaaatcaatgaatgcccagatctaacgtggtttcctccttgtccaagccttgaaacgttgaaattggtaaaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatcaatgttatctcaaatcactgcccacaaattgtcttactcacctcaacataaaagtaagagattccgaaggggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcaaattttcatatatagaagaccaggaagatgagggcgaagacaacatcatattctggaaatcctttcctcaaaacctccgcagtttggaaattaaaggctcttgcaaaatgacaagtttgcccatggggatgcagtacttaacctccctccaaaccctccatctatcatattgtgatgaattgaattcccttccagaatggataagcagcttatcatctcttcaatccctgttcatatacaattgtccagccctgaaatcactaccagaagcaatgaagaacctcacctcccttcagagacttgagatacagcattgtccagacctagctgaaagatgcagaaaacccaacggggaggactatcccaaaattcaacacatccccaaaattgaaatatggtag

SEQ ID NO: 15 - protein, 1147 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRGRGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTTRSEKTANVIGKRHFYTLECLSPDYSWSLFEMSAFQKGHEQENHDELVDIGKKIVEKCYNNPLAITVVGSLLYGEEISKWRSFEMSELAKIGNGDNKILSILKLSYYNLANSLKSCFSYCAVFPKDHEIKKEMLIELWMAQGYVVPLDGGQSIEDAAEEHFVILLRRCFFQDVKKDKYGDVDSVKIHDLMHDVAQEVGREEICVVNDNTKNLGDKIRHVHGDVNRYAQRVSLCSHKIRSYIGGKCEKRWVDTLIDKWMCLRMLDLSRSDVKNLPNSIGKLLHLRCLNLSYNDLLILPDAITRLHNLQTLLLKDCGSLMELPKDFCKLVKLRHLDLRDCDDLIGMPLGMDRLTSLRVLPFFVVGRKEQSVDDELKALKGLTEIKGSIDITIYSKYRIVEGMNDTGAGYLKSMKHLREIGITFDGGCVNPEAVLETLEPPSNIKSLSIDNYDGTTIPVWGRAEINWAISLSHLVDIWFCGCSNLQEMPVLSKLPHLKSLYLFMFCKLEYMESRSSSSSSDTEAATPELPTFFPSLEKLTLWYLEKLKGLGNRRSSSFPRLSKLEINECPDLTWFPPCPSLETLKLVKNNEALQIIVKITTTRGKEEKEEDKNAGVGNSQDDDNVKLWKVEIDNQCYLKSLPTNCLTHLNIKVRDSEGEEIELEVGEAFQKCASSLRSLIIIGNHGINKVMRLSGRTGLEHFTLLDSLKFSYIEDQEDEGEDNIIFWKSFPQNLRSLEIKGSCKMTSLPMGMQYLTSLQTLHLSYCDELNSLPEWISSLSSLQSLFIYNCPALKSLPEAMKNLTSLQRLEIQHCPDLAERCRKPNGEDYPKIQHIPKIEIW

SEQ ID NO: 16 - DNA, 6117 bp, Spinacia oleracea
atggctgaaatcggatactcggtttgttcaaaacttattgaagtgatgggcagtaagatcattaaagagatttgtgacatgtggggttacaaatctcatcttgaagacctcaacaaatctgtcttgacgatcaaggatgtgctcttggatgctgaggcgaagcgggatctttcccgtgaacaacagagttacattgcagaacttaaggatgttgtttacgatgctgatgatttgttcgatgagttcctcactcttgctgagctcaaacagattgatggcaacaacaagggtggtggtaaattctccaaaaaggtacgtcgtttcttttcttctaataaggagaagatgggtcaagcttacaagatgtctcatatggttaaagaaattaagaagcagttgggtgaaattgttgataggtataccaaatttgggtttattgttgattataaacctattattaggagaagggaggaaacatgttcttattttgtaggtgccaaggagattgttgggagggataaggataaagatgttatcataggcatgttgctagatcatgataacgattgtagtttcttggctgttgtgggggttggaggggtgggaaaaactactcttgcccaacttgtgtataatgatgaaagagtcaaaagtgagttccaagatttgaggtattgggtttgtgtctctgatcaagatgggggacaatttgatgacaaaagaattctttgtaagattatagagttagttacgggccagattcctccgagtaacgagagcatggaatcggtgcgtaagaaatttcaagaggaattaggaggaaagaagtacttccttgttcttgatgatgtatggaacgaggatcgccagaagtggcttcatctagaaaatttcttgaaattgggtcaagggggaagcaagattgtggtaaccacacgttcagagaagacggcaaatgttatagggaaaagacaagactataaactagaatgtttgtcagcagaggattcatggcgcttatttgaaatgtcagcttttgacgaagggcatggccaggaaaactatgacgaattagtgacgattggcaagaagattgttgaaaaatgttataacaatccacttgctataacagtggtaggaagccttctttttggacaagagataaataagtggcggtcgtttgaaagcagtggattagcccaaattgccaatggtgataatcagattttcccgatattaaagctcagttaccacaatcttccacactccttgaagagctgctttagctattgtgcagtgtttcccaaagattatgaaataaagaaggagatgttgattgatctttggatagcacaaggatacattataccgttggatggaggtcaaagtatagaagatgctgccgaggaacattttgtaattttgttaagaagatgtttctttcaagatgtaaagaaggattctcttggtaatgttgattatgttaaaatccacgacttaatgcacgatgtcgctcaagaagtggggaaggaggaaatctgtgtagtgacttcaggtacaaagaagttggctgataaaatccgtcacgtgggttgtgttgtcgatagagatccagaaatagtctttttatgtagcaataagattcgttcgtatattagcggtcgttgtataaagaatccggtggattcacaaatagacaactggatgcgccttagggtgttggacttgtcagattcatgtgttaaagatttgtctgattcaataggtaagctgctgcacttaaggtatcttaacctctcttctaatataaagttggagataatccctgatgcaattacaagactgcataacttgcagacactacttttagaatattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattagatttgatgatagagaaggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagcttagtttttgtagaaatttgcaggagatgccagtgctgagtaaactgcctcatttgaaatcactggaacttacagagttggataacttagagtacatggagagtagaagcagcagcagtagcagtgacacagaagcagcaacaccagaattaccaacattcttcccttcccttgaaaaactttcactttggggtctggaaaagttgaagggtttggggaacaggagatcgagtagttttccccgcctctctaaattggaaatctgggaatgcccagatctaacgtcatttccttcttgtccaagccttgaaaagttggaattgaaagaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatctgggttatctcaaatcactgcccacaaattgtcttactcacctcgaccttacaataagagattccaaggagggggagggtgaatgggaagttggggaggcatttcagaagtgtgtatcttctttgagaaagctcagcataatcggaaatcacggaataaataaagtgaagagactgtctggaagaacagggttggagcatttcactctgttggactcactcgaactttcaaatatagaagaccaggaagatgagggcgaagacaacatcatgttctggaaatcctttcctcaaaacctccgcaatttggaaattaattactctgacaaaatgacaagttttcccatggggatgcagtacttaacctccctccaaaccatccatctttatgattgttataaattgaattccattccagaatggataagcagcttatcatctcttcaatccctgcacataggaaaatgtccagccctaaaatcactaccagaagcaatgcggaacctcacctcccttcagagacttacgatatggcagtgtccagacctaattgaaagatgcaaagaacctaacggggaggactatcccaaaattgtaagtcattgcagaaagtaatttattcatttatatttattttatgcttagaatgatatacgcagtcgtcctttggtttcaaatcttgaatttggtttttgttttctttctttgtttctttattcaacaccagtccatttatgattgattcattaaaaaaaggatggagttttatggatttgaagaagacaacgaattgagattcctggggtttttttttcgttggggttggttttcatgtatatgttgctgattaaataccagactgatgatgatgatgtgtttatgggttttaaatcagattaaatatatgggaaatgtaagttaattggggatgcacataaggtgtttgatgaaatgtctattagaaatgttgtttcttggacttagaatgatatacactgtcgtcctttggtttccaatctggaatttggtttttgttttcttagtttgtttctttattccacactagcccattttttttaaactacctgcaactactgaatttcatttaccctgtatctcagattatatggtagtaattctcatttactcaacactagcttgatcctgaacgcagccaaccttcaggttagaatccgccttactcatccttttgtcatgaattgttttaagttgttttgcttgcttgtgtaatcataattcatagtatacgattcatcattcactatgtctataggcaagatattggaattgttcacgatttcctgaagtttctttgtttttgttgataccaccatattgcagcttatagtgactaagttaatgaatgtttccaaaaattagtcatataaattcttcttctctctctattacataaactctttttctctttctaacttatcatgttcatgtctaaaacgtatacatgctcacatcattgttcgtttcagctgacttacttatgtaagagagctatctagttaacaactcttgtaactttttatttgctagtcagaacatggattggtgcaagcatgggaatttgccaacactctaccaaatcgattggagtttggacttagtttcaccagaagccatacccggacacttactggggactgtcaacaaagccgcattgtgatgtacttggatgtttcacgtgcctgaggtgtgagttacttggaagggaagcggtttatttaattgttttcctaagtagattttgcttacaagcttttacttttcacttggaagggttttcttgttttaagcttttcgaattagagtttcggttgcattaagagtagtcgtattagtcttttttacctaagactcttttttgtaattttcagactatgcaattcaagttttgagtgttttcttgcttgtgtgattgtgagttggtgaattcgtctttcatacattttgagattatcagaagctttatgctccaccggtagtctagtaccttttctgttactgtacgtgcagggaagtaatctggtaccttctatatatatggaaaaacatacattatacattacgcaaaattcttacaggttagttacttcctggaacttcatttacacttggttttttttgttccattccctcggaagactattccctctgagaaatatgtaatgaatttctgtattcagctgcatttacaatgaagtttaagcagacactctctttatatagtgcctctttctggagcaccgtagagctgtctgtggttgatcaccatatgctgccgagagattcagcaatcgcgtgtttgatcaggtaaaagtttttatgtcaatgtgttttttttttccgtttgatcaatttatgtctgtattcagattcttatcttcttacagtagcataacacattgtttctttcatttatgtaaactgtttcaagattacagagatgtatgcttcagtcgacattgatgataacttaagatggcattcctacaacagttgcaggcgcattctaactccggcaattctagttaggcaagaggagcattgccaatacctgccacctctgggatttactataccagggttgaagtttatggaagacaccagctatgcacaagccttcaaggggtcatcctacataacaagttgaaccaaccaattgcttgttggttcagtggtaattggagctgaattcggtagggatggcccgtgttcgatccccacaacaacaattgggaggggactggaacctatccacacagaactcgccctgaatccggattagccctaagggtgaacggggtgctaacaccaaaaaaaaaacataacaagttgaatcaaacatactttgtttgaattgaagatttagtgatttcatttgatcgattgagatgtcttattataagcgtatatgctcttggatttggccacttaggtgttgtttgacaattggtcattaactcgcttttatattttcgtttctcttaggaaaggtgatcctgagaatttatattgaaacactttttttatctctcactagctttaaaaaagtgttctgtgttacctgcaattcaacttgattatttttcacatagttttacctgaaaaagtgttatctgaaaatcaactgacataaatttttgtttggatcaaattaaggatactagataaatcggaaaaaataatcaaccaattaagtacttcataattaaatatgaagtatattattatcttatgcttgtg

SEQ ID NO: 17 - DNA, 2000 bp, Spinacia oleracea
tggtccacaactccacactaagaggaactccaatgcttagttacaaggtggtgtagttaaaaagtaattccaatagttaactacacggtattatagttaaatttgccaactcaaatttctaactacaatatatttaagctacaaagtttctcattggctgactacaatacgttgtagcgccttataatattttattcaatatacaattttatttattttacctttttaacaatttttttttgatctacctgctgtcctgttcatatgagctacactaatttgatagctgcttacgcaattcttatatcaacggttggctacttgttcaaatatttttatttttttacgagtaagtcattttatgatcattgaagtggctctattattattatcatgcaccgattaacgcaagaataattaactcggtacgaattagtttcaaaataaaatccctcaaaaaaaaaagtttcaaaataaaattaacagaaaaccaaccttctccggtttactgttgttagagcatggaattttccagtaatcgcagaccccaaattatcttccagttgaatcaatccttgatttttggatttgccagaaaactccttgaattttagggttcatatttgatccgtaattgggaaaattttcagcaattgatcttccaaatcagccctacttgtttccagactgcaaatgaaaggtgcgaactttatactgcattttggttttccattagtgtaatttattaagatgaactgcattttgcaattgttttattcgactactcatttttaaatcaaattgcttaattgctagttagttttcttatcatattgccaaaaaaaattatttttgtttaattggtgaaaaagggtaaattatacctagtgtacaagattttcttgcacaccacccttaatttgttgacacatcatcaaacgtactgaaaaatgagaatgaaagacaataaatatgtcattttaaccaatagaaaaacatgatgtagtaagatccttaattgatagataaataattaaatatcagtccattagttgaatattcaatgaaaatgtatggtccaaaaatggcgtttaatagtcaatgtcatgctttatggggtggtggagtactatgtgactgtgtgtggacttggagaagactagagagtatgattatcaacctatggaccctcaaaatgaaaatgaaaatgatgtttttacactttaaaatcgtcaagaaacaacaatcctttttagcaatagtatttacacgcgctagttgcacgaactttaatgcaaatagtataaatttacggtcaaagttttcatactttagacacatactctctccgtcccttaatactcgcaccgctttccttttcgggccgtcccttaatacttgcaccgcttctataaatggaaatctatttctcacaattacctactaacccacctacactcatcgtccctacaaaaaatcatttaaaaattcacaccccacactcaccactcctcacccattacacatttcctactaactatattaaaaaaatatcccactataaactaacactcattaaattaataagtcaattcaaatatcttaaactccgcaccggtcaaatcggtgcgagtattaagggacggagggagtattatagagtgtaaataactttcatgaatggagggagtaaaaaattgttttacttggctaaaatacttttgttcttattggcagataaacatgagtccattattggccaacttgaacatatacctccaaacaataatcaatgatgtcgattatgaagtttgtgaatgcaatttattatcactttcattgcaagttgtcatctgtgctgagtgttgatttataaaaaggactacttgattaacacatacaatattactccacctttctccagacaacctttcttttctgcttttatcttgttttctcatcttaattcatctcttcatctttctgaaaaacccaaccca

SEQ ID NO: 18 - DNA, 3444 bp, Spinacia oleracea
atggctgaaatcggatactcggtttgttcaaaacttattgaagtgatgggcagtaagatcattaaagagatttgtgacatgtggggttacaaatctcatcttgaagacctcaacaaatctgtcttgacgatcaaggatgtgctcttggatgctgaggcgaagcgggatctttcccgtgaacaacagagttacattgcagaacttaaggatgttgtttacgatgctgatgatttgttcgatgagttcctcactcttgctgagctcaaacagattgatggcaacaacaagggtggtggtaaattctccaaaaaggtacgtcgtttcttttcttctaataaggagaagatgggtcaagcttacaagatgtctcatatggttaaagaaattaagaagcagttgggtgaaattgttgataggtataccaaatttgggtttattgttgattataaacctattattaggagaagggaggaaacatgttcttattttgtaggtgccaaggagattgttgggagggataaggataaagatgttatcataggcatgttgctagatcatgataacgattgtagtttcttggctgttgtgggggttggaggggtgggaaaaactactcttgcccaacttgtgtataatgatgaaagagtcaaaagtgagttccaagatttgaggtattgggtttgtgtctctgatcaagatgggggacaatttgatgacaaaagaattctttgtaagattatagagttagttacgggccagattcctccgagtaacgagagcatggaatcggtgcgtaagaaatttcaagaggaattaggaggaaagaagtacttccttgttcttgatgatgtatggaacgaggatcgccagaagtggcttcatctagaaaatttcttgaaattgggtcaagggggaagcaagattgtggtaaccacacgttcagagaagacggcaaatgttatagggaaaagacaagactataaactagaatgtttgtcagcagaggattcatggcgcttatttgaaatgtcagcttttgacgaagggcatggccaggaaaactatgacgaattagtgacgattggcaagaagattgttgaaaaatgttataacaatccacttgctataacagtggtaggaagccttctttttggacaagagataaataagtggcggtcgtttgaaagcagtggattagcccaaattgccaatggtgataatcagattttcccgatattaaagctcagttaccacaatcttccacactccttgaagagctgctttagctattgtgcagtgtttcccaaagattatgaaataaagaaggagatgttgattgatctttggatagcacaaggatacattataccgttggatggaggtcaaagtatagaagatgctgccgaggaacattttgtaattttgttaagaagatgtttctttcaagatgtaaagaaggattctcttggtaatgttgattatgttaaaatccacgacttaatgcacgatgtcgctcaagaagtggggaaggaggaaatctgtgtagtgacttcaggtacaaagaagttggctgataaaatccgtcacgtgggttgtgttgtcgatagagatccagaaatagtctttttatgtagcaataagattcgttcgtatattagcggtcgttgtataaagaatccggtggattcacaaatagacaactggatgcgccttagggtgttggacttgtcagattcatgtgttaaagatttgtctgattcaataggtaagctgctgcacttaaggtatcttaacctctcttctaatataaagttggagataatccctgatgcaattacaagactgcataacttgcagacactacttttagaatattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattagatttgatgatagagaaggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagcttagtttttgtagaaatttgcaggagatgccagtgctgagtaaactgcctcatttgaaatcactggaacttacagagttggataacttagagtacatggagagtagaagcagcagcagtagcagtgacacagaagcagcaacaccagaattaccaacattcttcccttcccttgaaaaactttcactttggggtctggaaaagttgaagggtttggggaacaggagatcgagtagttttccccgcctctctaaattggaaatctgggaatgcccagatctaacgtcatttccttcttgtccaagccttgaaaagttggaattgaaagaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatctgggttatctcaaatcactgcccacaaattgtcttactcacctcgaccttacaataagagattccaaggagggggagggtgaatgggaagttggggaggcatttcagaagtgtgtatcttctttgagaaagctcagcataatcggaaatcacggaataaataaagtgaagagactgtctggaagaacagggttggagcatttcactctgttggactcactcgaactttcaaatatagaagaccaggaagatgagggcgaagacaacatcatgttctggaaatcctttcctcaaaacctccgcaatttggaaattaattactctgacaaaatgacaagttttcccatggggatgcagtacttaacctccctccaaaccatccatctttatgattgttataaattgaattccattccagaatggataagcagcttatcatctcttcaatccctgcacataggaaaatgtccagccctaaaatcactaccagaagcaatgcggaacctcacctcccttcagagacttacgatatggcagtgtccagacctaattgaaagatgcaaagaacctaacggggaggactatcccaaaattattatatggtag

SEQ ID NO: 19 - protein, 1147 aa, Spinacia oleracea
MAEIGYSVCSKLIEVMGSKIIKEICDMWGYKSHLEDLNKSVLTIKDVLLDAEAKRDLSREQQSYIAELKDVVYDADDLFDEFLTLAELKQIDGNNKGGGKFSKKVRRFFSSNKEKMGQAYKMSHMVKEIKKQLGEIVDRYTKFGFIVDYKPIIRRREETCSYFVGAKEIVGRDKDKDVIIGMLLDHDNDCSFLAVVGVGGVGKTTLAQLVYNDERVKSEFQDLRYWVCVSDQDGGQFDDKRILCKIIELVTGQIPPSNESMESVRKKFQEELGGKKYFLVLDDVWNEDRQKWLHLENFLKLGQGGSKIVVTTRSEKTANVIGKRQDYKLECLSAEDSWRLFEMSAFDEGHGQENYDELVTIGKKIVEKCYNNPLAITVVGSLLFGQEINKWRSFESSGLAQIANGDNQIFPILKLSYHNLPHSLKSCFSYCAVFPKDYEIKKEMLIDLWIAQGYIIPLDGGQSIEDAAEEHFVILLRRCFFQDVKKDSLGNVDYVKIHDLMHDVAQEVGKEEICVVTSGTKKLADKIRHVGCVVDRDPEIVFLCSNKIRSYISGRCIKNPVDSQIDNWMRLRVLDLSDSCVKDLSDSIGKLLHLRYLNLSSNIKLEIIPDAITRLHNLQTLLLEYCRSLKELPKDFCKLVKLRHLDLRGCQCLIGMPLGMDRLISLRVLPKVVVGKKEQSDDQLKALKGLTEIKGSIDITIYSKYRIVEGMNDTGGAGYLKSMKHLTGVDIRFDDREGGCVNPEAVLATLEPPSNIKRLEMWHYSGTTIPVWGRAEINWAISLSHLVDIQLSFCRNLQEMPVLSKLPHLKSLELTELDNLEYMESRSSSSSSDTEAATPELPTFFPSLEKLSLWGLEKLKGLGNRRSSSFPRLSKLEIWECPDLTSFPSCPSLEKLELKENNEALQIIVKITTTRGKEEKEEDKNAGVGNSQDDDNVKLWKVEIDNLGYLKSLPTNCLTHLDLTIRDSKEGEGEWEVGEAFQKCVSSLRKLSIIGNHGINKVKRLSGRTGLEHFTLLDSLELSNIEDQEDEGEDNIMFWKSFPQNLRNLEINYSDKMTSFPMGMQYLTSLQTIHLYDCYKLNSIPEWISSLSSLQSLHIGKCPALKSLPEAMRNLTSLQRLTIWQCPDLIERCKEPNGEDYPKIIIW

SEQ ID NO: 20 - DNA, 6060 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaggatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcaaggtcggatgttaaaaatttgcctaattcaataggtaaattgttgcacttgaggtatcttaacctgtcagataatagaaatctaaagatacttcctgatgcaattacaagactgcataatttgcagacacttcttttagtagattgcagaagtttaaaggagttgccaaaagatttttgcaaattggtcaaactgaggcacttggaattacagggttgtcatgatttgattggtatgccatttggaatggataagctaactagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggacctttataatttgattagtttagagtacatggagagcacaagcagaagcagtagcagtgacacagaagcagcaacaccagaattaccaacattcttcccttcccttgaaaaacttacactttggcgtctggacaagttgaagggttttgggaacaggagatcgagtagttttccccgcctctctgaattggaaatctgggaatgcccagatctaacgtcatttccttcttgtccaagccttgaagagttggaattggaagaaaacaatgaagcgttgcaaataatagtaaaaataacaacaacaagaggtaaagaagaaaaagaagaagacaagaatgctggtgttggaaattcacaagatgatgacaatgtcaaattatggacggtggaaatagacaatctgggttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggactcactcaaattttcaaagatagaagaccaggaagatgagggcgaagacaacatcatattctggaaatcctttcctcaaaacctccgcagtttgagaattgaagactctgacaaaatgacaagttttcccatggggatgcagtacttaacctccctccaaaccatccatctttatgattgttataaattgaattccattccagaatggataagcagcttatcatctcttcaatccctgcacataggaaaatgtccagccctaaaatcactaccagaagcaatgcggaacctcacctcccttcagagacttacgatatggcagtgtccagacctaattgaaagatgcaaagaacctaacggggaggactatcccaaaattcaacacatccccaaaattgtaagtcattgcagaaagtaatttattcatttatatttattttatgcttagaatgatatacgcagtcgtcctttggtttcaaatcttgaatttggtttttgttttctttctttgtttctttattcaacaccagtccatttatgattgattcattaaaaaaaggatggagttttgtggatttgaagaagacaacgaattgagattcgtggggttttctttttgttggggttggatttcatgtatatgttgctgattgaatacgagactgatgatgatgatgtgtttaatttatgggttttaaatcagattaaatatatgggaaatgtaagttaattggggatgcacataaggtgtttgatgaaatgtctattagaaatgttgtttcttggacttagaatgatatacactgtcgtcctttggtttccaatcttacatttggttagaatccggcttactcatccttttgtccagttttcaagtaattgttttggcaggatcaattctctaattgttgtacaccgtatattgcaatttatagtgactacagttaatgaatgtttacaaaaaattagtcatgtaaaaacttcttctctgtccattacataaactctttttctctttctaacttatcatgttcatgtctaaacaattaaacatgctcacatcaatgttcatttaagctaacttacttctgtaagagagcgagctagttaaaaactcctttaactttctgttttatactcaggacatggattgatgcaagcatgaagaacttcgggaatttgctaaaactctaccaaagcgatgagagtttggactttatttcacttgaagtcagggactgtcaacaaagccacagtgtgcatgttggctgtttcacttggacgataaaaaggtttatttaattgttttcctaagtgtatttggcttacaagcttttacttttcacttgaaagggtttttcttgttttaagcttttcgaattagagttttcggttgaagtaagagtagtcgtattagtcttttacctaaggaagactcttttttgtaattttcagactatgcaattcaagttttcgagtgttttcttgcttgtgtgattgtgagttggtgaattcgtctttcatacattttgagattatcagaagctttatgctccaccggtagtctagtaccttttctgttactgtgcagggaagtaatctggtaccttctatatatatggaaaaacatacattatacattatgcaaaattcttacaggttagttacttcctggaacttcatttacacttagttttttttgttccattccctcggaatcaagtcattccctctgagaaatatgtaatgaacttctgtatgttgctgtttggttcctgttttaatcttcaattttcttgtatagttacagctgcatttacaatgaagtttaagcagacactctctttatatagtgcctctttctggagcaccgtagagctgtctgtggttgatcaccatctgctgccgagagattcagcaatcgcgtgtttgatcaggtaaaagtttttatgtcaatgtgtttttttttccgtttgatcaatttatgtctgtattcagattcttatcttcttacagtagcataacacattgtttctttcatttatgtaaactgtttcaagattacagagatgtatgcttcagtcgacattgatgataacttaagatggcattcctacaacagttgcaggcgcattctaactccggcaattctagttaggcaagaggagcattgccaatacctgccacctctgggatttactataccagggttgaagtttatggaagacaccagctatgcacaagccttcaaggggtcatcctacataacaagttgaaccaaccaattgcttgttggttcagtggtaattggagctgaatttggtagggatggcccgtgttcgatccccacaacaacaattgggaggggactggaacctatccacacagaactcgccctgaatccggattagccctaagggtgaacggggtgctaacaccaaaaaaaaaaacataacaagttgaaccaaacatactttgtttgaattgaagatttagtgatttcatttgatcgattgagatgtcttattataagcgtatatgctcttggatttggccacttaggtgttgtttgacaattggacattaactcgcttttatattttcttttctcttaggaaaggtgatcctgagaatttatattggaacactttttttttctcactagctttaaaaaagtgttctgtgttacctgcaattcaatttgattatttttcacatagttttacctgaaaaagtgttacctgaaaaagtgttacctgaaaatcaactgacataagtttttgtttggatccaattaaggacactagataaatcggaataaataatcaaccaattaagtacttcataattaaatatgaagtgtattattatcttatgcttgtgacattgaaggatgttatgatattttaactcaataccttgcaaaatatactggttaaatttcttaacaaggtaacttggcaacaaattcaggttgaaagctttgagaaatagagctacgaaacat

SEQ ID NO: 21 - DNA, 2000 bp, Spinacia oleracea
tttgaagttaggcttaacttgctcaccaattcttaaatagactcgacttacactgaatttattgtgtactatgtctagaaagtaaggtcaacaactttcttctaaattattttggcatgtttattagggttattatgaaaaacatatcaaattggtgttgttagttaggcttgaataatatgattttaagtcacgagacttttataaattaggtaatttgatttaaaaaattgttacatatctaagaaaatggatgttaaatttatcagtcaatgtataaacaataaaagtcaatatgtatgtaaaagggttgctagataaaatctttggttttttggtccacaactccacactaagaggaactccaatgcttagttacaaggtggtgtagttaaaaagtaactccaatagttaactacacggtattatagttaaatttgccaactcaaatttctaactacaatatatttaagctacaaagtttctcattggctgactacaatacgttgtagcgccttataatattttattcaatatacaattttatttattttacctttttaacaatttttttttgatctacctgctgtcctgttcatatgagctacactaatttgatagctgcttacgcaattcttatatcaacggttggctacttgttcaaatatttttatttttttacgagtaagtcattttatgatcattgaagtggctctattattattatcatgcaccgattaacgcaagaataattaactcggtacgaattagtttcaaaataaaatccctcaaaaaaaaaagtttcaaaataaaattaacagaaaaccaaccttctccggtttactgttgttagagcatggaattttccagtaatcgcagaccccaaattatcttccagttgaatcaatccttgatttttggatttgccagaaaactccttgaattttagggttcatatttgatccgtaattgggaaaattttcagcaattgatcttccaaatcagccctacttgtttccagactgcaaatgaaaggtgcgaactttatactgcattttggttttccattagtgtaatttattaagatgaactgcattttgcaattgttttattcgactactcatttttaaatcaaattgcttaattgctagttagttttcttatcatattgccaaaaaaaattatttttgtttaattggtgaaaaagggtaaattatacctagtgtacaagattttcttgcacaccaccgttaatttgttgacacatcatcaaacgtactgaaaaatgagaatgaaagacaataaatatgtcattttaaccaatagaaaaacatgatgtagtaagatccttaattgatagataaataattaaatatcagtccattagttgaatattcaatgaaaatgtatggtccaaaaatggcgtttaatagtcaatgtcatgctttatggggtggtggagtactatgtgactgtgtgtggacttggagaagactagagagtatgattatcaacctatggaccctcaaaatgaaaatgaaaatgatgtttacacgtgctatttgcgcggacttcaatgcaaatagtataaatttacggtcaaagttttcattctaaagcgtaaataactttcatgattggaggacggtagtataagtataacgttatagcctaccattttcttatcatattcacataaatttgttgctgaaatttgttttacttggctaaaatacttttgttcttattggcagataaacatcagtacgtccattattggccaacttgctgagtccattattggccaacttgaacatatacctccaaacaataatcaataatgtcgattatgaagtttgtgaatgcaatttattatcactttcatttataaaatgactacttgattaacacatacaatattacctttctccaaacaccctttcaattctgcttaatcttgttttctcatcatctcttcatctttctgaaaacacaaccca

SEQ ID NO: 22 - DNA, 3462 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaggatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcaaggtcggatgttaaaaatttgcctaattcaataggtaaattgttgcacttgaggtatcttaacctgtcagataatagaaatctaaagatacttcctgatgcaattacaagactgcataatttgcagacacttcttttagtagattgcagaagtttaaaggagttgccaaaagatttttgcaaattggtcaaactgaggcacttggaattacagggttgtcatgatttgattggtatgccatttggaatggataagctaactagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggacctttataatttgattagtttagagtacatggagagcacaagcagaagcagtagcagtgacacagaagcagcaacaccagaattaccaacattcttcccttcccttgaaaaacttacactttggcgtctggacaagttgaagggttttgggaacaggagatcgagtagttttccccgcctctctgaattggaaatctgggaatgcccagatctaacgtcatttccttcttgtccaagccttgaagagttggaattggaagaaaacaatgaagcgttgcaaataatagtaaaaataacaacaacaagaggtaaagaagaaaaagaagaagacaagaatgctggtgttggaaattcacaagatgatgacaatgtcaaattatggacggtggaaatagacaatctgggttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggactcactcaaattttcaaagatagaagaccaggaagatgagggcgaagacaacatcatattctggaaatcctttcctcaaaacctccgcagtttgagaattgaagactctgacaaaatgacaagttttcccatggggatgcagtacttaacctccctccaaaccatccatctttatgattgttataaattgaattccattccagaatggataagcagcttatcatctcttcaatccctgcacataggaaaatgtccagccctaaaatcactaccagaagcaatgcggaacctcacctcccttcagagacttacgatatggcagtgtccagacctaattgaaagatgcaaagaacctaacggggaggactatcccaaaattcaacacatccccaaaattgacatggattga

SEQ ID NO: 23 - protein, 1153 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRGRGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTTRSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIELWMAQGYVVPLDGGQSIEDAAEEHFVILLRRCFFQDVKKDKYGDVDSVKIHDLMHDVAQEVGREELCVVNDNTKNLGDKIRHVHRDVIRYAQRVSLCSHSHKIRSYIGGNCEKRCVDTLIDKWMCLRMLDLSRSDVKNLPNSIGKLLHLRYLNLSDNRNLKILPDAITRLHNLQTLLLVDCRSLKELPKDFCKLVKLRHLELQGCHDLIGMPFGMDKLTSLRVLPKVVVGKKEQSDDQLKALKGLTEIKGSIDITIYSKYRIVEGMNDTGGAGYLKSMKHLTGVDIRFDDREGGFVNPEAVLATLEPPSNIKSLSIHRFDGKTLPVWGRAEINWAISLSHLVDIQLWHCRNLQEMPVLSKLPHLKSLDLYNLISLEYMESTSRSSSSDTEAATPELPTFFPSLEKLTLWRLDKLKGFGNRRSSSFPRLSELEIWECPDLTSFPSCPSLEELELEENNEALQIIVKITTTRGKEEKEEDKNAGVGNSQDDDNVKLWTVEIDNLGYLKSLPTNCLTHLDLTIRDSKEGEGEWEVGDAFQKCVSSLRSLTIIGNHGINKVKRLSGRTGLEHFTLLDSLKFSKIEDQEDEGEDNIIFWKSFPQNLRSLRIEDSDKMTSFPMGMQYLTSLQTIHLYDCYKLNSIPEWISSLSSLQSLHIGKCPALKSLPEAMRNLTSLQRLTIWQCPDLIERCKEPNGEDYPKIQHIPKIDMD

SEQ ID NO: 24 - DNA, 6266 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaagggggaacgagagggaaacacgttcatatatagatgtcaagaatattcttgggagggataaagataagaatgatatcatagataggttgcttaatcgtaatgataatgaagcttgtagtttcctgaccatagtgggagcgggaggattgggaaaaactgctcttgcccaacttgtgttcaatgatgaaagggtcaaaattgagtttcatgatttgaggtattgggtttgtgtctctgatcaagatgggggccaattttatgtgaaagagatcctttgtaagattttagagatggttactaaggagaaagttgataatagttccgcattggaattggtacaaagccaatttcaagagaagttaagaggaaagaagtacttccttgttcttgatgatgtatggaacgaggatcgtgagaagtggtttcaattggaagagttgttaatgttgggtcaagggggaagcaaggttgtagtgaccgcacgttcagagaagacagcaaatgtcatagggaaaagacatttttatacactggaatgtttgtcgccagattattcatggagcttatttgaaatgtcggcttttcagaaagggcatgagcaggaaaaccatgacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgtcgatattgaagctcagttactacaatcttgcaaactctttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaaatatgtgtagtgaatgataatacaaagaacttgggtgataaaatccgtcatgtacatggtgatgtcaatagatatgcacaaagagtctctctgtgtagccataagattcgttcgtatattggtggtaaatgtgaaaaacgttgggtggatacactaatagacaagtggatgtgtcttaggatgttggacttgtcaaggtcggatgttaaaaatttgcctaattcaataggtaaattgttgcacttgaggtatcttaacctgtcagataatagaaatctaaagatacttcctgatgcaattacaagactgcataatttgcagacacttcttttagtagattgcagaagtttaaaggagttgccaaaagatttttgcaaattggtcaaactgaggcacttggaattacagggttgtcatgatttgattggtatgccatttggaatggataagctaactagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggggtctggaaaagttgaagggtttggggaacaggagatcgagtagttttccccgcctctctaaattggaaatctgggaatgccctgatctaacgtcatttccttcttgtccaagccttgaagagttggaattggaagaaaacaatgaagcgttgcaaataatagtaaaaataacaacaacaagaggtaaagaagaaaaagaagaagacaagaatgctggtgttggaaattcacaagatgatgacaatgtcaaattatggacggtggaaatagacaatctgggttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggactcactcaaattttcaaagatagaagaccaggaagatgagggcgaagacaacatcatattctggaaatcctttcctcaaaacctccgcagtttgagaattgaagactctgacaaaatgacaagtttgcccatggggatgcagtacttaacctccctccaaaccctctatctacaccattgttatgaattgaattcccttccagaatggataagcagcttatcatctcttcaatccctgcacataggaaaatgtccagccctaaaatcactaccagaagcaatgcggaacctcacctcccttcagagacttacgatatggcagtgtccagacctaattgaaagatgcaaagaacctaacggggaggactatcccaaaattcaacacatccccaaaattgtaagtcattgcagaaagtaatttattcatttatatttattttatgcttagaatgatatacgcagtcgtcctttggtttccaatcttgaatttggtttttgttttctttctttgtttctttattcaacaccagtccatttatgattgattcattaaaaaaaggatggagttttatggatttgaagaagacaacgaattgagattcctggggttttttttttcgttggggttggttttcatgtatatgttgctgattaaataccagactgatgatgatgatgtgtttatgggttttaaatcagattaaatatatgggaaatgtaagttaattggggatgcacataaggtgtttgatgaaatgtctatgagaaatgttgtttcttggacttagaatgatatacactgtcgtcctttggtttccaatcttacatttggtttgtgttttcttagtttgtttctttaatcaacaccagcccattttttttaaactacctgcaactactaattttcatttaccctgtatctcaggaaatatggtagtaattctcatttactcaacactagcttgatcctgaacgcagccaaccttcaggttagaatccgccttactcatccttttgtcatgcattgttttaagttgttttgcttgcttgtgtaatcataattcatagtatacgattcatcattcactatgtctacaggcaagatattggaattgttcacgattccctgaagtttctttgtttttgttgataccaccatattgcagcttatagtgactaagttaatgaatgtttccaaaaaattagtcatataaattcttcttctctctctattacataaactctttttctctttctaacttatcatgttcatgcctaaaacttatacatgctcacatcattgttcgtttgagctgacttacttctgtaagagagctatctagttaacaactcttgtaactttttatttgctagtcagaacatggattggtgcaagcatgggaatttgctaacactctaccaaatcgattggagtttagacttagtttcaccagaagccatacccggacacttactggggactgtcaacaaagccgcattgtgatgtacttggatgtttcacgtgcctgaggtgcgagttacttggaagggaagcggtttatttaattgttttccgaagtagattttgcttacaagcttttacttttcccttgaaagggtttttcttgttttaagcttttcgaattagagtttcggttgcattaagagtagtcgtattagtcttttttacctaagactcttttttgtaattttcagactatgcaattcaagttttcgagtgttttcttgcttgtgtgattgtgagttggtgaattcgtctttcatacattttgagattatcagaagctttatgctccaccggtagtctagtaccttttctgttactgtacgtgcagggaagtaatctggtaccttctatatatatggaaaaacatacattatacattatgcaaaattcttacaggttagttacttcctggaacttcatttacactttgttttttttgttccattccctcggaagactattccctctgagaaatatgtaatgaacttctgtatgttgctgtttggttcctgttttaatcttcaattttcttgtatagttacagctgcatttacaatgaagtttaagcagacactctctttatatagtgcttctttctggagcaccgtagagctgtctgtggttgatcaccatctgctgccgagagattcagcaatcgcatgtttgatcaggtaaaagtttttatgtcaatgtgtttttttttccgtttgatcaatttatgtctgtattcagattcttatcttcttatagtagcataacacattgtttctttcatttatgtaaactgtttcaagattacagagatgtatgcttcagtcgacattgatgataacttaagatggcattcctacaacagttgcaggcgcattctaactccggcaattctagttaggcaagaggagcattgccaatacctgccacctctgggatttactataccagggttgaagtttatggaagacaccagctatgcacaagccttcaaggggtcatcctacataacaagttgaaccaaccaattgcttgttggtttagtggtaattggagctgaatttggtagggatggcccgtgttcgatccccacaacaacaattgggaggggactggaacctatccacacagaactcgccctgaatccggattagtcctaagggtgaacggggtgctaacaccaaaaaaaaaaacataacaagttgaaccaaacatactttgtttgaattgaagatttagtgatttcatttgatcgattgagatgtcttattataagcgtatatgctcttggatttggccacttaggtgttgtttgacaattggtcattaactcgcttttatattttcttttctcttaggaaaggtgatcctgataatttatattggaacactttttttttctctcactagctttaaaaaagtgttctgtgttacctgcaattcaatttgattatttttcacatagttttacctgaaaaagtgttacctgaaaatcaactgacataagtttttgtttggatccaattaaggacactagataaaccggaataaataatcaaccaattaagtacttcataattaaatatgaagtgtattattatcttatgcttgtgacattgaaggatgttatgatattttaactcaataccttgcaaaatatactggttaaatttcttaacaaggtaacttggcaacaaatt

SEQ ID NO: 25 - DNA, 2000 bp, Spinacia oleracea; identical to SEQ ID NO: 13

SEQ ID NO: 26 - DNA, 3456 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaagggggaacgagagggaaacacgttcatatatagatgtcaagaatattcttgggagggataaagataagaatgatatcatagataggttgcttaatcgtaatgataatgaagcttgtagtttcctgaccatagtgggagcgggaggattgggaaaaactgctcttgcccaacttgtgttcaatgatgaaagggtcaaaattgagtttcatgatttgaggtattgggtttgtgtctctgatcaagatgggggccaattttatgtgaaagagatcctttgtaagattttagagatggttactaaggagaaagttgataatagttccgcattggaattggtacaaagccaatttcaagagaagttaagaggaaagaagtacttccttgttcttgatgatgtatggaacgaggatcgtgagaagtggtttcaattggaagagttgttaatgttgggtcaagggggaagcaaggttgtagtgaccgcacgttcagagaagacagcaaatgtcatagggaaaagacatttttatacactggaatgtttgtcgccagattattcatggagcttatttgaaatgtcggcttttcagaaagggcatgagcaggaaaaccatgacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgtcgatattgaagctcagttactacaatcttgcaaactctttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaaatatgtgtagtgaatgataatacaaagaacttgggtgataaaatccgtcatgtacatggtgatgtcaatagatatgcacaaagagtctctctgtgtagccataagattcgttcgtatattggtggtaaatgtgaaaaacgttgggtggatacactaatagacaagtggatgtgtcttaggatgttggacttgtcaaggtcggatgttaaaaatttgcctaattcaataggtaaattgttgcacttgaggtatcttaacctgtcagataatagaaatctaaagatacttcctgatgcaattacaagactgcataatttgcagacacttcttttagtagattgcagaagtttaaaggagttgccaaaagatttttgcaaattggtcaaactgaggcacttggaattacagggttgtcatgatttgattggtatgccatttggaatggataagctaactagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggggtctggaaaagttgaagggtttggggaacaggagatcgagtagttttccccgcctctctaaattggaaatctgggaatgccctgatctaacgtcatttccttcttgtccaagccttgaagagttggaattggaagaaaacaatgaagcgttgcaaataatagtaaaaataacaacaacaagaggtaaagaagaaaaagaagaagacaagaatgctggtgttggaaattcacaagatgatgacaatgtcaaattatggacggtggaaatagacaatctgggttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggactcactcaaattttcaaagatagaagaccaggaagatgagggcgaagacaacatcatattctggaaatcctttcctcaaaacctccgcagtttgagaattgaagactctgacaaaatgacaagtttgcccatggggatgcagtacttaacctccctccaaaccctctatctacaccattgttatgaattgaattcccttccagaatggataagcagcttatcatctcttcaatccctgcacataggaaaatgtccagccctaaaatcactaccagaagcaatgcggaacctcacctcccttcagagacttacgatatggcagtgtccagacctaattgaaagatgcaaagaacctaacggggaggactatcccaaaattcaacacatccccaaaattgaaatatggtag

SEQ ID NO: 27 - protein, 1151 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRGRGNERETRSYIDVKNILGRDKDKNDIIDRLLNRNDNEACSFLTIVGAGGLGKTALAQLVFNDERVKIEFHDLRYWVCVSDQDGGQFYVKEILCKILEMVTKEKVDNSSALELVQSQFQEKLRGKKYFLVLDDVWNEDREKWFQLEELLMLGQGGSKVVVTARSEKTANVIGKRHFYTLECLSPDYSWSLFEMSAFQKGHEQENHDELVDIGKKIVEKCYNNPLAITVVGSLLYGEEISKWRSFEMSELAKIGNGDNKILSILKLSYYNLANSLKSCFSYCAVFPKDHEIKKEMLIELWMAQGYVVPLDGGQSIEDAAEEHFVILLRRCFFQDVKKDKYGDVDSVKIHDLMHDVAQEVGREEICVVNDNTKNLGDKIRHVHGDVNRYAQRVSLCSHKIRSYIGGKCEKRWVDTLIDKWMCLRMLDLSRSDVKNLPNSIGKLLHLRYLNLSDNRNLKILPDAITRLHNLQTLLLVDCRSLKELPKDFCKLVKLRHLELQGCHDLIGMPFGMDKLTSLRVLPKVVVGKKEQSDDQLKALKGLTEIKGSIDITIYSKYRIVEGMNDTGGAGYLKSMKHLTGVDIRFDDREGGFVNPEAVLATLEPPSNIKSLSIHRFDGKTLPVWGRAEINWAISLSHLVDIQLWHCRNLQEMPVLSKLPHLKSLELYNLISLEYMESTSRSSSSDTEAATPELPTFFPSLEKLTLWGLEKLKGLGNRRSSSFPRLSKLEIWECPDLTSFPSCPSLEELELEENNEALQIIVKITTTRGKEEKEEDKNAGVGNSQDDDNVKLWTVEIDNLGYLKSLPTNCLTHLDLTIRDSKEGEGEWEVGDAFQKCVSSLRSLTIIGNHGINKVKRLSGRTGLEHFTLLDSLKFSKIEDQEDEGEDNIIFWKSFPQNLRSLRIEDSDKMTSLPMGMQYLTSLQTLYLHHCYELNSLPEWISSLSSLQSLHIGKCPALKSLPEAMRNLTSLQRLTIWQCPDLIERCKEPNGEDYPKIQHIPKIEIW

SEQ ID NO: 28 - DNA, 7286 bp, Spinacia oleracea
atggctgaaatcggatactcggtttgttcaaaacttattgaagtgatgggcagtaagatcattaaagagatttgcgacatgtggggttacaaatctcatcttgaagacctcaacaaatctgtcttgacgatcaaggatgtgctcttggatgctgaggcgaagcgggatctttcccgtgaacaacagagttacattgcagaacttaaggatgttgtttacgatgctgatgatttgttcgatgagttcctcactcttgctgagctcaaacagattgatggcaacaacaagggtggtggtaaattctccaaaaaggtacgtcgtttcttttcttctaataaggagaagatgggtcaagcttacaagatgtctcatatggttaaagaaattaagaagcagttgggtgaaattgttgataggtataccaaatttgggtttattgttgattataaacctattattaggagaagggaggaaacatgttcttattttgtaggtgccaaggagattgttgggagggataaggataaagatgttatcataggcatgttgctagatcatgataacgattgtagtttcttggctgttgtgggggttggaggggtgggaaaaactactcttgcccaacttgtgtataatgatgaaagagtcaaaagtgagttccaagatttgaggtattgggtttgtgtctctgatcaagatgggggacaatttgatgacaaaagaattctttgtaagattatagagttagttacgggccagattcctccgagtaacgagagcatggaatcggtgcgtaagaaatttcaagaggaattaggaggaaagaagtacttccttgttcttgatgatgtatggaacgaggatcgccagaagtggcttcatctagaaaatttcttgaaattgggtcaagggggaagcaagattgtggtaaccacacgttcagagaagacggcaaatgttatagggaaaagacaagactataaactagaatgtttgtcagcagaggattcatggcgcttatttgaaatgtcagcttttgacgaagggcatggccaggaaaactatgacgaattagtgacgattggcaagaagattgttgaaaaatgttataacaatccacttgctataacagtggtaggaagccttctttttggacaagagataaataagtggcggtcgtttgaaagcagtggattagcccaaattgccaatggtgataatcagattttcccgatattaaagctcagttaccacaatcttccacactccttgaagagctgctttagctattgtgcagtgtttcccaaagataatgaaataaagaaggagatgttgattgatctttggatagcacaaggatacattataccgttggatggaggtcaaagtatagaagatgctgccgaggaacattttgtaattttgttaagaagatgtttctttcaagatgtaaagaaggattctcttggtaatgttgattatgttaaaatccacgacttaatgcacgatgtcgctcaagaagtggggaaggaggaaatctgtgtagtgacttcaggtacaaagaagttggctgataaaatccgtcacgtgggttgtgttgtcgatagagatccagaaatagtctttttatgtagcaataagattcgttcgtatattagcggtcgttgtataaagaatccggtggattcacaaatagacaactggatgcgccttagggtgttggacttgtcagattcatgtgttaaagatttgtctgattcaataggtaagctgctgcacttaaggtatcttaacctctcttctaatataaagttggagataatccctgatgcaattacaagactgcataacttgcagacactacttttagaatattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattagatttgatgatagagaaggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagcttagtttttgtagaaatttgcaggagatgccagtgctgagtaaactgcctcatttgaaatcactggaacttacagagttggataacttagagtacatggagagtagaagcagcagcagtagcagtgacacagaagcagcaacaccagaattaccaacattcttcccttcccttgaaaaactttcactttggggtctggaaaagttgaagggtttggggaacaggagatcgagtagttttccccgcctctctaaattggaaatctgggaatgcccagatctaacgtcatttccttcttgtccaagccttgaaaagttggaattgaaagaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatctgggttatctcaaatcactgcccacaaattgtcttactcacctcgaccttacaataagagattccaaggagggggagggtgaatgggaagttggggaggcatttcagaagtgtgtatcttctttgagaaagctcagcataatcggaaatcacggaataaataaagtgaagagactgtctggaagaacagggttggagcatttcactctgttggactcactcgaactttcaaatatagaagaccaggaagatgagggcgaagacaacatcatgttctggaaatcctttcctcaaaacctccgcaatttggaaattaattactctgacaaaatgacaagttttcccatggggatgcagtacttaacctccctccaaaccatccatctttatgattgttataaattgaattccattccagaatggataagcagcttatcatctcttcaatccctgcacataggaaaatgtccagccctaaaatcactaccagaagcaatgcggaacctcacctcccttcagagacttacgatatggcagtgtccagacctaattgaaagatgcaaagaacctaacggggaggactatcccaaaattgtaagtcattgcagaaagtaatttattcatttatatttattttatgcttagaatgatatacaccgtcgtcctttggtttcaaatcttgaatttggtttttgttttctttctttgtttctttattcaacaccagcccatttatgattgattcattaaaaaaaggatggagttttgtggatttgaagaagacaacgaattgagattcctggggttttctttttgttggggttggatttcatgtatatgttgctgattaaatacgagactgatgatgatgatgatgtgtttatgggttttaaatcagattaaatatatgggaaatgtaagttaatttgggatgcacataaggtgtttgctgaaatgtctatgagaaatgttgtttcttggacttagaatgatatacactgtcgtccattggtttccaatcttacatttggtttgtgttttcttagtttgtttctttaatcaacaccaacccatttttttaaaactacctgcaactactaatttacgttgaccctgtatctcaggtactaaatgaatattggtgattttcagttactcaacactagcttgatcctgaacgcacccaaccttcaggttagaatccggcttactcatccttttgtccagttttcaagtaattgttttggcaggatcaattctctaattgttgtacaccgtatattgcaatttatagtgactacagttaatgaatgtttacaaaaaattagtcatgtaaaaacttcttctctgtccattacataaactctttttctctttctaacttatcatgttcatgtctaaaaaattaaacatgctcacatcaatgttcatttaagctaacttacttctgtaagagagcgagctagttaaaaactcctttaactttctgttttatactcaggacatggattgatgcaagcatgaagaacttcgggaatttgctaaaactctaccaaagcgatgagagtttggactttgtttcacttgaagtcagggactgtcaacaaagccacagtgtgcatgttggctgtttcacttggacgataaaaaggtttatttaattgttttcctaagtgtatttggcttacaagcttttacttttcgcttgaaagggtttttcttgttttaagctttttgaattagagtttcggttgaagtaagagtagtcgtattagtcttttactttgcaggagtctatgcctatataaggtaagactcgtatttgtaattttcagattatgcaattcaagttttcgagtgttttcttaaaaaaacatatcatacctgtgtgtagcataaagataaattctgatgctgtgcttcttgttatggctcacattggttttcattgtttggattgtttcacagggaagcagagaatacctggaacctgtaaaggacgctatatctatagcagctttcacaggccaagtaatataatgttctttatcaatcactcaatacctggagattgtttgaacacataattcacctctttttttccatctcaaattgcagacttttactgggatttgaatgacagcaaacatttgattgtcacgaggattgatctaactggtgaatgttgtgatcaccatattggtctttctcattcaaacaaacttgcataccgttcttttgaagtttgaagacaagcaggcgataatcaactcaggtcgaagctcatgtgcaggagagaatagaatatagaggagattatttttaaaagaaacgctcaaaggtattgtagcacctttcctatttgctactgcagtgatgtttttatttcttgtttgcagcgcttgtttctcatatttcaacctacttttagaaaaaaaaacatctccgaacataaccaaaaataaagttcccttatcagtgctttccctgctttcttctaaacaacatatacaattataaaccctttttctctcttacctttgttattcttccttgcttcattgagataacactctcctgtttttgttttgttgttagtcattacatggatatatcaaggacaacagttctgtagtccgtcaactgtggttaggaaggctaaactggagcacaataaccccatgtcaattgaatagtaaaggtgtgctatatcagtttcgtttggcttggcttacctgaaaaatggctggttatttatccttgtctctttctatgacgtgcagtggcttgttaatgtgtctcggacaacaattcctcactttccaagttccatacacgctgatgtaactatcttctgcagtctgttctttcatttttgccacgtgctctaattataactttttgtactcaataatcaactccttgtcccggtatttgcagagactacttaaacaggtaaagtgacaatcctggcgaagttgtctgtttcttagctctgaacccatcattcaggtaagattaagtatttaagaagaaattttgtttttacctaaaatgaatgatcttgtgtaactgcttgcttcttgcattaaataagaactttctgctgcatatgtgacagttacatccacaaaaaagttggaggtttgttcagggattggaaatgaaggtacttcagaattcctggaatgtttatgaatgctccagacttcagagtctttaatggaaaattcgagtcactaaaaaaacattattcctatcatcagagctttgaagttcctctatacaaggtcaactgagttcctctttgcctcttgtttaattgtatttacttgtaccttaattataatctgtatattgttttagttaagttctaaaacaggttattattcatcatttgtgcagcatattgctggaatcaagaatctagtgcttcttcttcctgacttcactgtcaaaatagcagttcccatgctggaaataagcgcgctagcaatgtaattgatgacatggatgttgctgcttctgagttttgatcataaaaagctgttatgtgtttcttgaatgtaatgaaggagaggagaaaactgaaaactcttggcaaaaacgtgaaattgcagtgcctcggggtggtagggatcacccggattcagttcagacgatacttttttcaacccggtttgttccggttttcagcttcgggttttccttgtacttttggggcacacatacaaggctacttcatgtttgagaaacctaattgaggctatcttgtagcaaatgcacaccacactctttctctcttctctccttttttcaccttccatttgtaaaaatcctcttttaaaggttaataaaaaaaagcttcaagtctcgtagggtggatgtaggtcacattgaccgaaccacggtaaactctttgtgttctttcttctctctttgtttctcatttttacggcaagtgtttatggttaaccatgcatcttagaatagcttaaggcattaacataataacatcaatgttctccaaagattcaccttacttgttgtacataatcacaatgttaagcctatgaaggtagaatgctctcatgatttggtttaaccaaaaaataaactctaaaataatacggagtaataaaaattggccataaattatttacaaagtttgatttttgtatagggtatcttgtacttgtgataaaaaaaattaaaaaaaaaaaaattacttatttcttctatttttacttgttacacttttctacaacagaaacatcaaaacgcccgcaacacactataaatgaaaaaccattttgtatgcaatgatatttacgttctcactttattctctttaataactcctactacgtaattctcaccaatcaaataaaattatagaaattttcatttataccctcttaaaatgatgttgatttcttttttttttt

SEQ ID NO: 29 - DNA, 2000 bp, Spinacia oleracea
tggtccacaactccacactaagaggaactccaatgcttagttacaaggtggtgtagttaaaaagtaactccaatagttaactacacggtattatagttaaatttgccaactcaaatttctaactacaatatatttaagctacaaagtttctcattggctgactacaatacgttgtagcgccttataatattttattcaatatacaattttatttattttacctttttaacaatttttttttgatctacctgctgtcctgttcatatgagctacactaatttgatagctgcttacgcaattcttatatcaacggttggctacttgttcaaatatttttatttttttacgagtaagtcattttatgatcattgaagtggctctattattattatcatgcaccgattaacgcaagaataattaactcggtacgaattagtttcaaaataaaatccctcaaaaaaaaaagtttcaaaataaaattaacagaaaaccaaccttctccggtttactgttgttagagcatggaattttccagtaatcgcagaccccaaattatcttccagttgaatcaatccttgatttttggatttgccagaaaactccttgaattttagggttcatatttgatccgtaattgggaaaattttcagcaattgatcttccaaatcagccctacttgtttccagactgcaaatgaaaggtgcgaactttatactgcattttggttttccattagtgtaatttattaagatgaactgcattttgcaattgttttattcgactactcatttttaaatcaaattgcttaattgctagttagttttcttatcatattgccaaaaaaaattatttttgtttaattggtgaaaaagggtaaattatacctagtgtacaagattttcttgcacaccacccttaatttgttgacacatcatcaaacgtactgaaaaatgagaatgaaagacaataaatatgtcattttaaccaatagaaaaacatgatgtagtaagatccttaattgatagataaataattaaatatcagtccattagttgaatattcaatgaaaatgtatggtccaaaaatggcgtttaatagtcaatgtcatgctttatggggtggtggagtactatgtgactgtgtgtggacttggagaagactagagagtatgattatcaacctatggaccctcaaaatgaaaatgaaaatgatgtttttacactttaaaatcgtcaagaaacaacaatcctttttagcaatagtatttacacgcgctagttgcacgaactttaatgcaaatagtataaatttacggtcaaagttttcatactttagacacatactctctccgtcccttaatactcgcaccgctttccttttcgggccgtcccttaatacttgcaccgcttctataaatggaaatctatttctcacaattacctactaacccacctacactcatcgtccctacaaaaaatcatttaaaaattcacaccccacactcaccactcctcacccattacacatttcctactaactatattaaaaaaatatcccactataaactaacactcattaaattaataagtcaattcaaatatcttaaactccgcaccggtcaaatcggtgcgagtattaagggacggagggagtattatagagtgtaaataactttcatgaatggagggagtaaaaaattgttttacttggctaaaatacttttgttcttattggcagataaacatgagtccattattggccaacttgaacatatacctccaaacaataatcaatgatgtcgattatgaagtttgtgaatgcaatttattatcactttcattgcaagttgtcatctgtgctgagtgttgatttataaaaaggactacttgattaacacatacaatattactccacctttctccagacaacctttcttttctgcttttatcttgttttctcatcttaattcatctcttcatctttctgaaaaacccaaccca

SEQ ID NO: 30 - DNA, 3453 bp, Spinacia oleracea
atggctgaaatcggatactcggtttgttcaaaacttattgaagtgatgggcagtaagatcattaaagagatttgcgacatgtggggttacaaatctcatcttgaagacctcaacaaatctgtcttgacgatcaaggatgtgctcttggatgctgaggcgaagcgggatctttcccgtgaacaacagagttacattgcagaacttaaggatgttgtttacgatgctgatgatttgttcgatgagttcctcactcttgctgagctcaaacagattgatggcaacaacaagggtggtggtaaattctccaaaaaggtacgtcgtttcttttcttctaataaggagaagatgggtcaagcttacaagatgtctcatatggttaaagaaattaagaagcagttgggtgaaattgttgataggtataccaaatttgggtttattgttgattataaacctattattaggagaagggaggaaacatgttcttattttgtaggtgccaaggagattgttgggagggataaggataaagatgttatcataggcatgttgctagatcatgataacgattgtagtttcttggctgttgtgggggttggaggggtgggaaaaactactcttgcccaacttgtgtataatgatgaaagagtcaaaagtgagttccaagatttgaggtattgggtttgtgtctctgatcaagatgggggacaatttgatgacaaaagaattctttgtaagattatagagttagttacgggccagattcctccgagtaacgagagcatggaatcggtgcgtaagaaatttcaagaggaattaggaggaaagaagtacttccttgttcttgatgatgtatggaacgaggatcgccagaagtggcttcatctagaaaatttcttgaaattgggtcaagggggaagcaagattgtggtaaccacacgttcagagaagacggcaaatgttatagggaaaagacaagactataaactagaatgtttgtcagcagaggattcatggcgcttatttgaaatgtcagcttttgacgaagggcatggccaggaaaactatgacgaattagtgacgattggcaagaagattgttgaaaaatgttataacaatccacttgctataacagtggtaggaagccttctttttggacaagagataaataagtggcggtcgtttgaaagcagtggattagcccaaattgccaatggtgataatcagattttcccgatattaaagctcagttaccacaatcttccacactccttgaagagctgctttagctattgtgcagtgtttcccaaagataatgaaataaagaaggagatgttgattgatctttggatagcacaaggatacattataccgttggatggaggtcaaagtatagaagatgctgccgaggaacattttgtaattttgttaagaagatgtttctttcaagatgtaaagaaggattctcttggtaatgttgattatgttaaaatccacgacttaatgcacgatgtcgctcaagaagtggggaaggaggaaatctgtgtagtgacttcaggtacaaagaagttggctgataaaatccgtcacgtgggttgtgttgtcgatagagatccagaaatagtctttttatgtagcaataagattcgttcgtatattagcggtcgttgtataaagaatccggtggattcacaaatagacaactggatgcgccttagggtgttggacttgtcagattcatgtgttaaagatttgtctgattcaataggtaagctgctgcacttaaggtatcttaacctctcttctaatataaagttggagataatccctgatgcaattacaagactgcataacttgcagacactacttttagaatattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattagatttgatgatagagaaggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagcttagtttttgtagaaatttgcaggagatgccagtgctgagtaaactgcctcatttgaaatcactggaacttacagagttggataacttagagtacatggagagtagaagcagcagcagtagcagtgacacagaagcagcaacaccagaattaccaacattcttcccttcccttgaaaaactttcactttggggtctggaaaagttgaagggtttggggaacaggagatcgagtagttttccccgcctctctaaattggaaatctgggaatgcccagatctaacgtcatttccttcttgtccaagccttgaaaagttggaattgaaagaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatctgggttatctcaaatcactgcccacaaattgtcttactcacctcgaccttacaataagagattccaaggagggggagggtgaatgggaagttggggaggcatttcagaagtgtgtatcttctttgagaaagctcagcataatcggaaatcacggaataaataaagtgaagagactgtctggaagaacagggttggagcatttcactctgttggactcactcgaactttcaaatatagaagaccaggaagatgagggcgaagacaacatcatgttctggaaatcctttcctcaaaacctccgcaatttggaaattaattactctgacaaaatgacaagttttcccatggggatgcagtacttaacctccctccaaaccatccatctttatgattgttataaattgaattccattccagaatggataagcagcttatcatctcttcaatccctgcacataggaaaatgtccagccctaaaatcactaccagaagcaatgcggaacctcacctcccttcagagacttacgatatggcagtgtccagacctaattgaaagatgcaaagaacctaacggggaggactatcccaaaattgtactaaatgaatattggtga

SEQ ID NO: 31 - DNA, 3486 bp, Spinacia oleracea
atggctgaaatcggatactcggtttgttcaaaacttattgaagtgatgggcagtaagatcattaaagagatttgcgacatgtggggttacaaatctcatcttgaagacctcaacaaatctgtcttgacgatcaaggatgtgctcttggatgctgaggcgaagcgggatctttcccgtgaacaacagagttacattgcagaacttaaggatgttgtttacgatgctgatgatttgttcgatgagttcctcactcttgctgagctcaaacagattgatggcaacaacaagggtggtggtaaattctccaaaaaggtacgtcgtttcttttcttctaataaggagaagatgggtcaagcttacaagatgtctcatatggttaaagaaattaagaagcagttgggtgaaattgttgataggtataccaaatttgggtttattgttgattataaacctattattaggagaagggaggaaacatgttcttattttgtaggtgccaaggagattgttgggagggataaggataaagatgttatcataggcatgttgctagatcatgataacgattgtagtttcttggctgttgtgggggttggaggggtgggaaaaactactcttgcccaacttgtgtataatgatgaaagagtcaaaagtgagttccaagatttgaggtattgggtttgtgtctctgatcaagatgggggacaatttgatgacaaaagaattctttgtaagattatagagttagttacgggccagattcctccgagtaacgagagcatggaatcggtgcgtaagaaatttcaagaggaattaggaggaaagaagtacttccttgttcttgatgatgtatggaacgaggatcgccagaagtggcttcatctagaaaatttcttgaaattgggtcaagggggaagcaagattgtggtaaccacacgttcagagaagacggcaaatgttatagggaaaagacaagactataaactagaatgtttgtcagcagaggattcatggcgcttatttgaaatgtcagcttttgacgaagggcatggccaggaaaactatgacgaattagtgacgattggcaagaagattgttgaaaaatgttataacaatccacttgctataacagtggtaggaagccttctttttggacaagagataaataagtggcggtcgtttgaaagcagtggattagcccaaattgccaatggtgataatcagattttcccgatattaaagctcagttaccacaatcttccacactccttgaagagctgctttagctattgtgcagtgtttcccaaagataatgaaataaagaaggagatgttgattgatctttggatagcacaaggatacattataccgttggatggaggtcaaagtatagaagatgctgccgaggaacattttgtaattttgttaagaagatgtttctttcaagatgtaaagaaggattctcttggtaatgttgattatgttaaaatccacgacttaatgcacgatgtcgctcaagaagtggggaaggaggaaatctgtgtagtgacttcaggtacaaagaagttggctgataaaatccgtcacgtgggttgtgttgtcgatagagatccagaaatagtctttttatgtagcaataagattcgttcgtatattagcggtcgttgtataaagaatccggtggattcacaaatagacaactggatgcgccttagggtgttggacttgtcagattcatgtgttaaagatttgtctgattcaataggtaagctgctgcacttaaggtatcttaacctctcttctaatataaagttggagataatccctgatgcaattacaagactgcataacttgcagacactacttttagaatattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattagatttgatgatagagaaggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagcttagtttttgtagaaatttgcaggagatgccagtgctgagtaaactgcctcatttgaaatcactggaacttacagagttggataacttagagtacatggagagtagaagcagcagcagtagcagtgacacagaagcagcaacaccagaattaccaacattcttcccttcccttgaaaaactttcactttggggtctggaaaagttgaagggtttggggaacaggagatcgagtagttttccccgcctctctaaattggaaatctgggaatgcccagatctaacgtcatttccttcttgtccaagccttgaaaagttggaattgaaagaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatctgggttatctcaaatcactgcccacaaattgtcttactcacctcgaccttacaataagagattccaaggagggggagggtgaatgggaagttggggaggcatttcagaagtgtgtatcttctttgagaaagctcagcataatcggaaatcacggaataaataaagtgaagagactgtctggaagaacagggttggagcatttcactctgttggactcactcgaactttcaaatatagaagaccaggaagatgagggcgaagacaacatcatgttctggaaatcctttcctcaaaacctccgcaatttggaaattaattactctgacaaaatgacaagttttcccatggggatgcagtacttaacctccctccaaaccatccatctttatgattgttataaattgaattccattccagaatggataagcagcttatcatctcttcaatccctgcacataggaaaatgtccagccctaaaatcactaccagaagcaatgcggaacctcacctcccttcagagacttacgatatggcagtgtccagacctaattgaaagatgcaaagaacctaacggggaggactatcccaaaattttactcaacactagcttgatcctgaacgcacccaaccttcaggacatggattga

SEQ ID NO: 32 - protein, 1150 aa, Spinacia oleracea
MAEIGYSVCSKLIEVMGSKIIKEICDMWGYKSHLEDLNKSVLTIKDVLLDAEAKRDLSREQQSYIAELKDVVYDADDLFDEFLTLAELKQIDGNNKGGGKFSKKVRRFFSSNKEKMGQAYKMSHMVKEIKKQLGEIVDRYTKFGFIVDYKPIIRRREETCSYFVGAKEIVGRDKDKDVIIGMLLDHDNDCSFLAVVGVGGVGKTTLAQLVYNDERVKSEFQDLRYWVCVSDQDGGQFDDKRILCKIIELVTGQIPPSNESMESVRKKFQEELGGKKYFLVLDDVWNEDRQKWLHLENFLKLGQGGSKIVVTTRSEKTANVIGKRQDYKLECLSAEDSWRLFEMSAFDEGHGQENYDELVTIGKKIVEKCYNNPLAITVVGSLLFGQEINKWRSFESSGLAQIANGDNQIFPILKLSYHNLPHSLKSCFSYCAVFPKDNEIKKEMLIDLWIAQGYIIPLDGGQSIEDAAEEHFVILLRRCFFQDVKKDSLGNVDYVKIHDLMHDVAQEVGKEEICVVTSGTKKLADKIRHVGCVVDRDPEIVFLCSNKIRSYISGRCIKNPVDSQIDNWMRLRVLDLSDSCVKDLSDSIGKLLHLRYLNLSSNIKLEIIPDAITRLHNLQTLLLEYCRSLKELPKDFCKLVKLRHLDLRGCQCLIGMPLGMDRLISLRVLPKVVVGKKEQSDDQLKALKGLTEIKGSIDITIYSKYRIVEGMNDTGGAGYLKSMKHLTGVDIRFDDREGGCVNPEAVLATLEPPSNIKRLEMWHYSGTTIPVWGRAEINWAISLSHLVDIQLSFCRNLQEMPVLSKLPHLKSLELTELDNLEYMESRSSSSSSDTEAATPELPTFFPSLEKLSLWGLEKLKGLGNRRSSSFPRLSKLEIWECPDLTSFPSCPSLEKLELKENNEALQIIVKITTTRGKEEKEEDKNAGVGNSQDDDNVKLWKVEIDNLGYLKSLPTNCLTHLDLTIRDSKEGEGEWEVGEAFQKCVSSLRKLSIIGNHGINKVKRLSGRTGLEHFTLLDSLELSNIEDQEDEGEDNIMFWKSFPQNLRNLEINYSDKMTSFPMGMQYLTSLQTIHLYDCYKLNSIPEWISSLSSLQSLHIGKCPALKSLPEAMRNLTSLQRLTIWQCPDLIERCKEPNGEDYPKIVLNEYW

SEQ ID NO: 33 - protein, 1161 aa, Spinacia oleracea
MAEIGYSVCSKLIEVMGSKIIKEICDMWGYKSHLEDLNKSVLTIKDVLLDAEAKRDLSREQQSYIAELKDVVYDADDLFDEFLTLAELKQIDGNNKGGGKFSKKVRRFFSSNKEKMGQAYKMSHMVKEIKKQLGEIVDRYTKFGFIVDYKPIIRRREETCSYFVGAKEIVGRDKDKDVIIGMLLDHDNDCSFLAVVGVGGVGKTTLAQLVYNDERVKSEFQDLRYWVCVSDQDGGQFDDKRILCKIIELVTGQIPPSNESMESVRKKFQEELGGKKYFLVLDDVWNEDRQKWLHLENFLKLGQGGSKIVVTTRSEKTANVIGKRQDYKLECLSAEDSWRLFEMSAFDEGHGQENYDELVTIGKKIVEKCYNNPLAITVVGSLLFGQEINKWRSFESSGLAQIANGDNQIFPILKLSYHNLPHSLKSCFSYCAVFPKDNEIKKEMLIDLWIAQGYIIPLDGGQSIEDAAEEHFVILLRRCFFQDVKKDSLGNVDYVKIHDLMHDVAQEVGKEEICVVTSGTKKLADKIRHVGCVVDRDPEIVFLCSNKIRSYISGRCIKNPVDSQIDNWMRLRVLDLSDSCVKDLSDSIGKLLHLRYLNLSSNIKLEIIPDAITRLHNLQTLLLEYCRSLKELPKDFCKLVKLRHLDLRGCQCLIGMPLGMDRLISLRVLPKVVVGKKEQSDDQLKALKGLTEIKGSIDITIYSKYRIVEGMNDTGGAGYLKSMKHLTGVDIRFDDREGGCVNPEAVLATLEPPSNIKRLEMWHYSGTTIPVWGRAEINWAISLSHLVDIQLSFCRNLQEMPVLSKLPHLKSLELTELDNLEYMESRSSSSSSDTEAATPELPTFFPSLEKLSLWGLEKLKGLGNRRSSSFPRLSKLEIWECPDLTSFPSCPSLEKLELKENNEALQIIVKITTTRGKEEKEEDKNAGVGNSQDDDNVKLWKVEIDNLGYLKSLPTNCLTHLDLTIRDSKEGEGEWEVGEAFQKCVSSLRKLSIIGNHGINKVKRLSGRTGLEHFTLLDSLELSNIEDQEDEGEDNIMFWKSFPQNLRNLEINYSDKMTSFPMGMQYLTSLQTIHLYDCYKLNSIPEWISSLSSLQSLHIGKCPALKSLPEAMRNLTSLQRLTIWQCPDLIERCKEPNGEDYPKILLNTSLILNAPNLQDMD

SEQ ID NO: 34 - DNA, 6194 bp, Spinacia oleracea
atggctgaaatcggatactcggtttgttcaaaacttattgaagtgatgggcagtaatatcattaaagagattcgcgacatgtggggttacaattctcatcttgaagacctcaacaaatctgtcttgacgatcaaggatgtgctcttggatgctgaggcgaagcgggatctttcccgtgaacaacagagttacattgcagaacttaaggatgttgtttacgatgctgatgatttgttcgatgagttcctcactcttgctgagctcaaacagattgatggaaacaagggtggtggtaaattctccaaaaaggtacgtcgtttcttttcttctaataaggagaagatgggtcaagcttacaagatgtctcatatggttaaagaaattaagaagcagttgggtgaaattgttgataggtataccaaatttgggtttattgttgattataaacctattattaggagaagggaggaaacatgttcttattttgtaggtgccaaggagattgttgggagggataaggataaagatgttatcataggcatgttgctagatcatgataacgattgtagtttcttggctgttgtgggggttggaggggtgggaaaaactactcttgcccaacttgtgtataatgatgaaagagtcaaaagtgagttccaagatttgaggtattgggtttgtgtctctgatcaagatgggggacaatttgatgacaaaagaattctttgtaagattatagagttagttacgggccagattcctccgagtaacgagagcatggaatcggtgcgtaagaaatttcaagaggaattaggaggaaagaagtacttccttgttcttgatgatgtatggaacgaggatcgccagaagtggcttcatctagaaaatttcttgaaattgggtcaagggggaagcaagattgtggtaaccacacgttcagagaagacggcaaatgttatagggaaaagacaagactataaactagaatgtttgtcagcagaggattcatggcgcttatttgaaatgtcagcttttgacgaagggcatggccaggaaaactatgacgaattagtgacgattggcaagaagattgttgaaaaatgttataacaatccacttgctataacagtggtaggaagccttctttttggacaagagataaataagtggcggtcgtttgaaagcagtggattagcccaaattgccaatggtgataatcagattttcccgatattaaagctcagttaccacaatcttccacactccttgaagagctgctttagctattgtgcagtgtttcccaaagataatgaaataaagaaggagatgttgattgatctttggatagcacaaggatacattataccgttggatggaggtcaaagtatagaagatgctgccgaggaacattttgtaattttgttaagaagatgtttctttcaagatgtaaagaaggattctcttggtaatgttgattatgttaaaatccacgacttaatgcacgatgtcgctcaagaagtggggaaggaggaaatctgtgtagtgacttcaggtacaaagaagttggctgataaaatccgtcacgtgggttgtgttgtcgatagagatccagaaatagtctttttatgtagcaataagattcgttcgtatattagcggtcgttgtataaagaatccggtggattcacaaatagacaactggatgcgccttagggtgttggacttgtcagattcatgtgttaaagatttgtctgattcaataggtaagctgctgcacttaaggtatcttaacctctcttctaatataaagttggagataatccctgatgcaattacaagactgcataacttgcagacactacttttagaagattgcagaagtttaaaggagttgccaaaagatttttgcaaattggtcaaactgaggcacttggaattacagggttgtcatgatttgattggtatgccatttggaatggataagctaactagtcttagaatactaccaaacattgtggtgggtaggaaggaacaaagtgatgatgagctgaaagccctaaaaggcctcatcgagataaaaggctccatttctatcagaatctattcaaagtatagaatagttgaaggcatgaatgacacaggaggagctgcttatttgaagagcatgaaacatctcagggagattgatattacatttttgggtgaatgtgttagccctgaagctgtattggaaaccttagagccaccttcaaatatcaagagcttatatatatataattacagtggtacaacaattccagtatggggaagagcagagattaattgggcaatctccctctcacatctcgtcgacatccagcttagttgttgtagtaatttgcaggagatgccagtgctgagtaaactgcctcatttgaaatcgctgaaacttggatggttggataacttagagtacatggagagtagcagtagcagtgacacagaagcagcaacaccagaattaccaacattcttcccttcccttgaaaaacttactttacagcatctggaaaagttgaagggttttgggaacaggagatcgagtagttttccccgcctctctgaattggaaatcaagaaatgcccagatctaacgtcatttccttcttgtccaagccttgagaagttggaattgaaagaaagcaatgaagcgttgcaaataatagtaaaaataacaacaagaggtaaagaaaaagaagagaacaataatgctggtgttggaaattcacaagatgatgacaaagtcaaattacggaagatggtgatagacaatctgggttatctcaaatcactgcccacaaattgtcttactcaccttgaaattgaggagtttattgaatcagattccgaggaagagattgaatcagaagtcggggaggaggaggttgaattggaagttgtggaggcatttcagaagtctgcatcttctctgcaaagcctcgaaatatacagaataaataaactgaatagactaactggaacaacaggattagtgcatttcagtgccttggacgaactcacattgaattttgtcgacgattttgaagtatcctttcctcaaagcctccgcagtttgaaaattgaatactcttataaaatgacaagtctgcccatggggatgcagtacttaacctccctccaaaccctcgaactaaaatgttgtgatgaattgaattcccttccagaatggataagcaacttatcatctcttcaatccctgtccatatcctactgtgaagccctgaaatcactaccagaagcaatgcagaacctcacctcccttcagagacttgtgataagagaatgtcgagacctagctgaaagatgcgaagaacccaatggggaagactatcacaaaattcaacacatccccaaaattgtaagtgattgcggaaagtgtttcttttatttatttttaattttatgcttagaatgatatacatcagcattcagcgtccattggtttccaatcttacatttggtttttgtttcttagtttgtttctttaatcaacaccagcccattttttttaaactacctgcaactactaattttcatttaccctgtatctcaggaaatatggtagtattctcatttactcaacactagcttgatcctgaacgcagccaaccttcaggttagaatccgccttactcatccttttgtcatgcattgttttaagttgttttgcttgcttgtgtaatcataattcatagtatacgattcatcattcactatgtctacaggcaagatattggaattgttcacgattccctgaagtttctttgtttttgttgataccaccatattgcagcttatagtgactaagttaatgaatgtttccaaaaaattagtcatataaattcttcttctctctctattacataaactctttttctctttctaactatcatgttcatgtctaaaacttatacatgctcacatcattgttcgtttcagctgacttacttctgtaagagagctatctagttaacaactcttgtaacattttatttgctagtcagaacatggattggtgcaagcatgggaatttgccaacactctaccaaatcgattggagtttggacttagtttcaccagaagccatacccggacacttactggggactgtcaacaaagccgcattatgatgtacttggatgtttcacgtgcctgaggtgtgagttacttggaagggaagcggtttatttaattgttttcctaagtagattttgcttagaagcttttacttttcacttgaaagggtttttcttgttttaagcttttcgaattagagtttcggttgcattaagagtagtcgtattagtctttttttacctaaggaagacttttttgtaattttcagacgatgcaattcaacttttcgagtgttttgttgcttgtgtgattgtgagtttgtgaatttgtctttcataaatattgagttcatcagaagctttatgctccaccggtagtctagtaccttttgttattgttcagggaagtaatctggtaccttctatatatatgagaaaacatacattatgcaaaattcttacaggttagttacttcctagaacttcagttatactttttttttgttccatgtccttggaatcaagtcattccctctgaaaaatgtgtactgaacttttgaaagttgctgtttgattcctgtttgaatcttcacttttcttgcatcgtgacagctgtgtttacaatgaagtttaagcagacactctctttatatagtgcctccttttggagcatcggagagttgtggctgatcactatgtgcgaccaagagattcattaatcgcgtgtttgatcaggtaaaagtttttatgtcaatgtgttttatttttctttctgtttgatcagtttatgtctgtattcagattcttatcttcttctagtagcataacaaatttgtttgtttcattatataaaccgtttcaggattacaaatgatcggacagagatgtatgcttcagtcgatattgatgataacttaaggtagtattgctagaacagttacagagctgtggctgatcactatgtgctgcaaacagattcatcaatcacgtgtttgataaggtagagttttcatgtcaacgcgttttttctgtttgatcaatttatgtctgtattcagattcttatctacttctagtagcataacatatctgtttctatcattatataattgtttcagggttacaaatgaccggacagagatgtatgcttcagtcgatattgatgctaacttaagatagcattgctagaacagtttcaggttgccattgaaatttgaaaacagaaagacaccatcaggtagagttttcatgtcaatgctttttttttttttgatcaatttatgtttgtataaaaatttgtatcttcttctatactataaattctatataacgtatctgtttatttcattataataaaccgtttcaggattacaaatgatcgaacagtgatgtatgcttcagtcgataacttcaggtagcattgccagaagaattgcagacacatcctaacttaagagggttatggttgattgactaactctcgaaattctagttaggcaagaggagcattgcagtacctgccttaaaaggggtcgtcttatatagatatctctatcagtagtcatttacgtcttaagtcctgaaataagttgaactaaacatactttgtttgaatcgaagatttagtgaattttactttgtatttgattgtgttgagatgaccgtagggaaaagttaactaattataagcgtaaattatgttcttggattcggcttttatattttcttttcgtttaataaaagtggtcatagagatattctacaatgtattttggtaagttacctaaaatttaatttgattatttttcacataattaatcaactgataaaattttatttggatcaaccgatcaagaagtgaaaacgtaaagaacaaaaagaaacagagggagtatattattatcttttacttttgatagtgaaggatgttatgatattttaactcaatcccttacaaaatatactggttaaatttcttaacaatgtagtactttggcaacaagttcaggttgaaagctttgagaaatagagttaggaaacataagaatcacaaaatttat

SEQ ID NO: 35 - DNA, 1752 bp, Spinacia oleracea
gtttgtgttataagttacaacaatttaaaaacggagaacatacttataatactagtgtaatctttggccggattatggtcgttgacaaaaaaactccggccttgaccctccacgtgccggtcaagtgacttaataaaccttttattccacccttttttcattcttctttttattcttctttttctctccattaatacaaatcaagtgattatgtcgatccgatccttctgttctctactgtaattgattacaccaacaacaaccaagcgaaacagtcaatgttaccgaattgaattgcggaaaatagtttatgattgattcattaaaaaaggatggagttttgtggatttgaataagacaacgaattgagattcctggggttttctttctgttggggttggatttcatgtacttgttgctgatcaaatatgtgattgaagattgaagatgatgatgtgtttatgggtttgaaatcggattaaatttatgggaaatgtaagtgaattggggatgcacataaggtgtttgatgaaatgtctatgagaaatattgtttcttgcacttgtatgataatttgtggggatttgattagttcatggtgcgagtttgatgcaacgccgaagagaaatcaggtctttagagaaactcaaatggttgaataggcttccaacaatgttgtttcgtagtacactgccatgattgatagagaaggaagcagatgaaggagaaggctcatgtgaccggcacatgggtagtaagtcaacgccggaaatcgtggtcaacgtccaaaaccgagctaaggtaacatattggagtacaagtaattacaacaaaaagtgttacttccttgtacattattattttacttgaaatgctagttgtgtttgtgcatctgtggaactctaaattaattaattaacaatcaaccaaacaactttagtgtaaattggccaaccttttgccatcagccacagaaaagtgaaatatcaccccattattgcccattctgtatttgcacttttttttaaggcatagcacagccggttttccggatcttagctccgtctacattcggatccgatccatttcgcacaccttatttgtggtggatgagtctcccaacaagaatttctcgctcgaaactgagaacccccttaagcggcatcaagttgcttaccacttgagccaactctatgttggtttctgcatttgcagttagttaggtcgtctgagtgcgaaatgggaatgctttatcacacactccacagtttagtcaggctgatggaaacgtaataattgagttatttgagtgttcaaacttaaagtcactcactcactcaaacactcaatactttctccatcttgttttctcattacatatgaaaacccaaacacctttcatttctgcttaatcttctttctctcatctttcagttattcacctgttcatctttctgaaaacaacccaaacacccttcatttctgtttaatcttctttcctcatcttcatccacctgtttatctttctgtaaacacaacccaaacacctttcatttctgatttatcttgttatctcatcttcattcacctgttcatctttctgaaaatctaaacacccttcatttctgctaatcttcttttctcatctccccctaaatcatctttctgaaaacccaaacacctttcttttctgcttttatcttgttttctcatcttaattcatctcttcatctttctgaaaaacccaaccca

SEQ ID NO: 36 - DNA, 3429 bp, Spinacia oleracea
atggctgaaatcggatactcggtttgttcaaaacttattgaagtgatgggcagtaatatcattaaagagattcgcgacatgtggggttacaattctcatcttgaagacctcaacaaatctgtcttgacgatcaaggatgtgctcttggatgctgaggcgaagcgggatctttcccgtgaacaacagagttacattgcagaacttaaggatgttgtttacgatgctgatgatttgttcgatgagttcctcactcttgctgagctcaaacagattgatggaaacaagggtggtggtaaattctccaaaaaggtacgtcgtttcttttcttctaataaggagaagatgggtcaagcttacaagatgtctcatatggttaaagaaattaagaagcagttgggtgaaattgttgataggtataccaaatttgggtttattgttgattataaacctattattaggagaagggaggaaacatgttcttattttgtaggtgccaaggagattgttgggagggataaggataaagatgttatcataggcatgttgctagatcatgataacgattgtagtttcttggctgttgtgggggttggaggggtgggaaaaactactcttgcccaacttgtgtataatgatgaaagagtcaaaagtgagttccaagatttgaggtattgggtttgtgtctctgatcaagatgggggacaatttgatgacaaaagaattctttgtaagattatagagttagttacgggccagattcctccgagtaacgagagcatggaatcggtgcgtaagaaatttcaagaggaattaggaggaaagaagtacttccttgttcttgatgatgtatggaacgaggatcgccagaagtggcttcatctagaaaatttcttgaaattgggtcaagggggaagcaagattgtggtaaccacacgttcagagaagacggcaaatgttatagggaaaagacaagactataaactagaatgtttgtcagcagaggattcatggcgcttatttgaaatgtcagcttttgacgaagggcatggccaggaaaactatgacgaattagtgacgattggcaagaagattgttgaaaaatgttataacaatccacttgctataacagtggtaggaagccttctttttggacaagagataaataagtggcggtcgtttgaaagcagtggattagcccaaattgccaatggtgataatcagattttcccgatattaaagctcagttaccacaatcttccacactccttgaagagctgctttagctattgtgcagtgtttcccaaagataatgaaataaagaaggagatgttgattgatctttggatagcacaaggatacattataccgttggatggaggtcaaagtatagaagatgctgccgaggaacattttgtaattttgttaagaagatgtttctttcaagatgtaaagaaggattctcttggtaatgttgattatgttaaaatccacgacttaatgcacgatgtcgctcaagaagtggggaaggaggaaatctgtgtagtgacttcaggtacaaagaagttggctgataaaatccgtcacgtgggttgtgttgtcgatagagatccagaaatagtctttttatgtagcaataagattcgttcgtatattagcggtcgttgtataaagaatccggtggattcacaaatagacaactggatgcgccttagggtgttggacttgtcagattcatgtgttaaagatttgtctgattcaataggtaagctgctgcacttaaggtatcttaacctctcttctaatataaagttggagataatccctgatgcaattacaagactgcataacttgcagacactacttttagaagattgcagaagtttaaaggagttgccaaaagatttttgcaaattggtcaaactgaggcacttggaattacagggttgtcatgatttgattggtatgccatttggaatggataagctaactagtcttagaatactaccaaacattgtggtgggtaggaaggaacaaagtgatgatgagctgaaagccctaaaaggcctcatcgagataaaaggctccatttctatcagaatctattcaaagtatagaatagttgaaggcatgaatgacacaggaggagctgcttatttgaagagcatgaaacatctcagggagattgatattacatttttgggtgaatgtgttagccctgaagctgtattggaaaccttagagccaccttcaaatatcaagagcttatatatatataattacagtggtacaacaattccagtatggggaagagcagagattaattgggcaatctccctctcacatctcgtcgacatccagcttagttgttgtagtaatttgcaggagatgccagtgctgagtaaactgcctcatttgaaatcgctgaaacttggatggttggataacttagagtacatggagagtagcagtagcagtgacacagaagcagcaacaccagaattaccaacattcttcccttcccttgaaaaacttactttacagcatctggaaaagttgaagggttttgggaacaggagatcgagtagttttccccgcctctctgaattggaaatcaagaaatgcccagatctaacgtcatttccttcttgtccaagccttgagaagttggaattgaaagaaagcaatgaagcgttgcaaataatagtaaaaataacaacaagaggtaaagaaaaagaagagaacaataatgctggtgttggaaattcacaagatgatgacaaagtcaaattacggaagatggtgatagacaatctgggttatctcaaatcactgcccacaaattgtcttactcaccttgaaattgaggagtttattgaatcagattccgaggaagagattgaatcagaagtcggggaggaggaggttgaattggaagttgtggaggcatttcagaagtctgcatcttctctgcaaagcctcgaaatatacagaataaataaactgaatagactaactggaacaacaggattagtgcatttcagtgccttggacgaactcacattgaattttgtcgacgattttgaagtatcctttcctcaaagcctccgcagtttgaaaattgaatactcttataaaatgacaagtctgcccatggggatgcagtacttaacctccctccaaaccctcgaactaaaatgttgtgatgaattgaattcccttccagaatggataagcaacttatcatctcttcaatccctgtccatatcctactgtgaagccctgaaatcactaccagaagcaatgcagaacctcacctcccttcagagacttgtgataagagaatgtcgagacctagctgaaagatgcgaagaacccaatggggaagactatcacaaaattcaacacatccccaaaattgaaatatggtag

SEQ ID NO: 37 - protein, 1142 aa, Spinacia oleracea
MAEIGYSVCSKLIEVMGSNIIKEIRDMWGYNSHLEDLNKSVLTIKDVLLDAEAKRDLSREQQSYIAELKDVVYDADDLFDEFLTLAELKQIDGNKGGGKFSKKVRRFFSSNKEKMGQAYKMSHMVKEIKKQLGEIVDRYTKFGFIVDYKPIIRRREETCSYFVGAKEIVGRDKDKDVIIGMLLDHDNDCSFLAVVGVGGVGKTTLAQLVYNDERVKSEFQDLRYWVCVSDQDGGQFDDKRILCKIIELVTGQIPPSNESMESVRKKFQEELGGKKYFLVLDDVWNEDRQKWLHLENFLKLGQGGSKIVVTTRSEKTANVIGKRQDYKLECLSAEDSWRLFEMSAFDEGHGQENYDELVTIGKKIVEKCYNNPLAITVVGSLLFGQEINKWRSFESSGLAQIANGDNQIFPILKLSYHNLPHSLKSCFSYCAVFPKDNEIKKEMLIDLWIAQGYIIPLDGGQSIEDAAEEHFVILLRRCFFQDVKKDSLGNVDYVKIHDLMHDVAQEVGKEEICVVTSGTKKLADKIRHVGCVVDRDPEIVFLCSNKIRSYISGRCIKNPVDSQIDNWMRLRVLDLSDSCVKDLSDSIGKLLHLRYLNLSSNIKLEIIPDAITRLHNLQTLLLEDCRSLKELPKDFCKLVKLRHLELQGCHDLIGMPFGMDKLTSLRILPNIVVGRKEQSDDELKALKGLIEIKGSISIRIYSKYRIVEGMNDTGGAAYLKSMKHLREIDITFLGECVSPEAVLETLEPPSNIKSLYIYNYSGTTIPVWGRAEINWAISLSHLVDIQLSCCSNLQEMPVLSKLPHLKSLKLGWLDNLEYMESSSSSDTEAATPELPTFFPSLEKLTLQHLEKLKGFGNRRSSSFPRLSELEIKKCPDLTSFPSCPSLEKLELKESNEALQIIVKITTRGKEKEENNNAGVGNSQDDDKVKLRKMVIDNLGYLKSLPTNCLTHLEIEEFIESDSEEEIESEVGEEEVELEVVEAFQKSASSLQSLEIYRINKLNRLTGTTGLVHFSALDELTLNFVDDFEVSFPQSLRSLKIEYSYKMTSLPMGMQYLTSLQTLELKCCDELNSLPEWISNLSSLQSLSISYCEALKSLPEAMQNLTSLQRLVIRECRDLAERCEEPNGEDYHKIQHIPKIEIW

SEQ ID NO: 38 - DNA, 7789 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcatggtcggatgttaaaaatttgcctaattcaataggtaaattgttgcacttgaggtgtcttaacctgtcttataataaagatctgttgatactccctgatgcaattacaagactgcataatttgcagacactgcttttaaaagagtgcagaagtttaaaggagttgccaaaagatttttgcaaattggtcaaactgaggcacttggatttaaggtgttctgatttgaaggagttgccaaaagatttttgcaaattggtcaaactgaggcacttggatttatggggttgtgatgatttgattggtgtgccattgggaatggataggctaattagtcttagagtactgccattctttgtggtgggtaggaaggaacaaagtgatgatgatgagctgaaagccctaaaaggcctcaccgagataaaaggctccattcgtattagaatctattcaaagtatagaatagttgaaggcatgaatgacacaggaggagctgggtatttaaagagcatgaaacatctcacgggggttgatattacatttgatggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggcgtctggacaagttgaagggttttgggaacaggagatcgagtagttttccccgcctctctaaattggaaatctggaaatgcccagatctaacgtcatttccttcttgtccaagccttgaagagttggaattgaaagaaaacaatgaagcattgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatccctgcacataggaaaatgtccagccctaaaatcactaccagaagcaatgcggaacctcacctcccttcagagacttacgatatggcagtgtccagacctaattgaaagatgcaaagaacctaacggggaggactatcccaaaattcaacacatccccaaaattgtaagtcattgcagaaagtaatttattcatttatatttattttatgcttagaatgatatacaccgtcgtcctttggtttcaaatcttgaatttggtttttgttttctttctttgtttctttattcaacaccagcccatttatgattgattcattaaaaaaaggatggagttttgtggatttgaagaagacaacgaattgagattcctggggttttctttttgttggggttggatttcatgtatatgttgctgattaaatacgagactgatgatgatgatgatgtgtttatgggttttaaatcagattaaatatatgggaaatgtaagttaatttgggatgcacataaggtgtttgctgaaatgtctatgagaaatgttgtttcttggacttagaatgatatacactgtcgtccattggtttccaatcttacatttggtttgtgttttcttagtttgtttctttaatcaacaccaacccatttttttaaaactacctgcaactactaatttacgttgaccctgtatctcaggtactaaataaatattggtgattttcagttactcaacactagcttgatcctgaacgcacccaaccttcaggttagaatccggcttactcatccttttgtccagttttcaagtaattgttttggcaggatcaattctctaattgttgtacaccgtatattgcaatttatagtgactacagttaatgaatgtttacaaaaaattagtcatgtaaaaacttcttctctgtccattacataaactctttttctctttctaacttatcatgttcatgtctaaaaaattaaacatgctcacatcaatgttcatttaagctaacttacttctgtaagagagcgagctagttaaaaactcctttaactttctgttttatactcaggacatggattgatgcaagcatgaagaacttcgggaatttgctaaaactctaccaaagcgatgagagtttggactttgtttcacttgaagtcagggactgtcaacaaagccacagtgtgcatgttggctgtttcacttggacgataaaaaggtttatttaattgttttcctaagtgtatttggcttacaagcttttacttttcgcttgaaagggtttttcttgttttaagctttttgaattagagtttcggttgaagtaagagtagtcgtattagtcttttactttgcaggagtctatgcctatataaggtaagactcgtatttgtaattttcagattatgcaattcaagttttcgagtgttttcttaaaaaaacatatcatacctgtgtgtagcataaagataaattctgatgctgtgcttcttgttatggctcacattggttttcattgtttggattgtttcacagggaagcagagaatacctggaacctgtaaaggacgctatatctatagcagctttcacaggccaagtaatataatgttctttatcaatcactcaatacctggagattgtttgaacacataattcacctctttttttccatctcaaattgcagacttttactgggatttgaatgacagcaaacatttgattgtcacgaggattgatctaactggtgaatgttgtgatcaccatattggtctttctcattcaaacaaacttgcataccgttcttttgaagtttgaagacaagcaggcgataatcaactcaggtcgaagctcatgtgcaggagagaatagaatatagaggagattatttttaaaagaaacgctcaaaggtattgtagcacctttcctatttgctactgcagtgatgtttttatttcttgtttgcagcgcttgtttctcatatttcaacctacttttagaaaaaaaaacatctccgaacataaccaaaaataaagttcccttatcagtgctttccctgctttcttctaaacaacatatacaattataaaccctttttctctcttacctttgttattcttccttgcttcattgagataacactctcctgtttttgttttgttgttagtcattacatggatatatcaaggacaacagttctgtagtccgtcaactgtggttaggaaggctaaactggagcacaataaccccatgtcaattgaatagtaaaggtgtgctatatcagtttcgtttggcttggcttacctgaaaaatggctggttatttatccttgtctctttctatgacgtgcagtggcttgttaatgtgtctcggacaacaattcctcactttccaagttccatacacgctgatgtaactatcttctgcagtctgttctttcatttttgccacgtgctctaattataactttttgtactcaataatcaactccttgtcccggtatttgcagagactacttaaacaggtaaagtgacaatcctggcgaagttgtctgtttcttagctctgaacccatcattcaggtaagattaagtatttaagaagaaattttgtttttacctaaaatgaatgatcttgtgtaactgcttgcttcttgcattaaataagaactttctgctgcatatgtgacagttacatccacaaaaaagttggaggtttgttcagggattggaaatgaaggtacttcagaattcctggaatgtttatgaatgctccagacttcagagtctttaatggaaaattcgagtcactaaaaaaacattattcctatcatcagagctttgaagttcctctatacaaggtcaactgagttcctctttgcctcttgtttaattgtatttacttgtaccttaattataatctgtatattgttttagttaagttctaaaacaggttattattcatcatttgtgcagcatattgctggaatcaagaatctagtgcttcttcttcctgacttcactgtcaaaatagcagttcccatgctggaaataagcgcgctagcaatgtaattgatgacatggatgttgctgcttctgagttttgatcataaaaagctgttatgtgtttcttgaatgtaatgaaggagaggagaaaactgaaaactcttggcaaaaacgtgaaattgcagtgcctcggggtggtagggatcacccggattcagttcagacgatacttttttcaacccggtttgttccggttttcagcttcgggttttccttgtacttttggggcacacatacaaggctacttcatgtttgagaaacctaattgaggctatcttgtagcaaatgcacaccacactctttctctcttctctccttttttcaccttccatttgtaaaaatcctcttttaaaggttaataaaaaaaagcttcaagtctcgtagggtggatgtaggtcacattgaccgaaccacggtaaactctttgtgttctttcttctctctttgtttctcatttttacggcaagtgtttatggttaaccatgcatcttagaatagcttaaggcattaacataataacatcaatgttctccaaagattcaccttacttgttgtacataatcacaatgttaagcctatgaaggtagaatgctctcatgatttggtttaaccaaaaaataaactctaaaataatacggagtaataaaaattggccataaactaattacaaagtttgatttttgtatagggtatcttgtacttgtgataaaaaaaattttaaaaaaattaaaaagtaaataaattacttattccttctatttttacttgttacacttttctacaacagaaacatcaaaacgcccgcaacacactataaatgaaaaaccattttgtatgcaatgatatttacgttctcactttattctctttaataactcctactacgtaattctcaccaatcaaataaaattatagaaattttcatttataccctcttaaaatgatgttgatttttttttttttttttaaggtgtgaaaaagtttgtgttatacttacaacaatttaaaaacggagaacatacttataatactagtgtaatctttggccggattatggtcgttgacaaaaaaactccggccttgaccctccacgtgccggtcaagttcttcttttttcattcttctttttattcttctttttctctccattaatacaaatcaagtgattatgtcgatccgatccttctgttctctactgtaattgattacaccaacaacaaccaagcgaaacagtcaatgttaccgaattgaattgcggaaaatagtttatgattgattcattaaaaaaggatggagttttgtggatttgaataagacaacgaattgagattcctggggttttctttctgttggggttggatttcatgtacttgtt

SEQ ID NO: 39 - DNA, 2000 bp, Spinacia oleracea; identical to SEQ ID NO: 13

SEQ ID NO: 40 - DNA, 3534 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcatggtcggatgttaaaaatttgcctaattcaataggtaaattgttgcacttgaggtgtcttaacctgtcttataataaagatctgttgatactccctgatgcaattacaagactgcataatttgcagacactgcttttaaaagagtgcagaagtttaaaggagttgccaaaagatttttgcaaattggtcaaactgaggcacttggatttaaggtgttctgatttgaaggagttgccaaaagatttttgcaaattggtcaaactgaggcacttggatttatggggttgtgatgatttgattggtgtgccattgggaatggataggctaattagtcttagagtactgccattctttgtggtgggtaggaaggaacaaagtgatgatgatgagctgaaagccctaaaaggcctcaccgagataaaaggctccattcgtattagaatctattcaaagtatagaatagttgaaggcatgaatgacacaggaggagctgggtatttaaagagcatgaaacatctcacgggggttgatattacatttgatggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggcgtctggacaagttgaagggttttgggaacaggagatcgagtagttttccccgcctctctaaattggaaatctggaaatgcccagatctaacgtcatttccttcttgtccaagccttgaagagttggaattgaaagaaaacaatgaagcattgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatccctgcacataggaaaatgtccagccctaaaatcactaccagaagcaatgcggaacctcacctcccttcagagacttacgatatggcagtgtccagacctaattgaaagatgcaaagaacctaacggggaggactatcccaaaattcaacacatccccaaaattgtactaaataaatattggtga

SEQ ID NO: 41 - DNA, 3567 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcatggtcggatgttaaaaatttgcctaattcaataggtaaattgttgcacttgaggtgtcttaacctgtcttataataaagatctgttgatactccctgatgcaattacaagactgcataatttgcagacactgcttttaaaagagtgcagaagtttaaaggagttgccaaaagatttttgcaaattggtcaaactgaggcacttggatttaaggtgttctgatttgaaggagttgccaaaagatttttgcaaattggtcaaactgaggcacttggatttatggggttgtgatgatttgattggtgtgccattgggaatggataggctaattagtcttagagtactgccattctttgtggtgggtaggaaggaacaaagtgatgatgatgagctgaaagccctaaaaggcctcaccgagataaaaggctccattcgtattagaatctattcaaagtatagaatagttgaaggcatgaatgacacaggaggagctgggtatttaaagagcatgaaacatctcacgggggttgatattacatttgatggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggcgtctggacaagttgaagggttttgggaacaggagatcgagtagttttccccgcctctctaaattggaaatctggaaatgcccagatctaacgtcatttccttcttgtccaagccttgaagagttggaattgaaagaaaacaatgaagcattgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatccctgcacataggaaaatgtccagccctaaaatcactaccagaagcaatgcggaacctcacctcccttcagagacttacgatatggcagtgtccagacctaattgaaagatgcaaagaacctaacggggaggactatcccaaaattcaacacatccccaaaattttactcaacactagcttgatcctgaacgcacccaaccttcaggacatggattga

SEQ ID NO: 42 - protein, 1177 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRGRGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTTRSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIELWMAQGYVVPLDGGQSIEDAAEEHFVILLRRCFFQDVKKDKYGDVDSVKIHDLMHDVAQEVGREELCVVNDNTKNLGDKIRHVHRDVIRYAQRVSLCSHSHKIRSYIGGNCEKRCVDTLIDKWMCLRMLDLSWSDVKNLPNSIGKLLHLRCLNLSYNKDLLILPDAITRLHNLQTLLLKECRSLKELPKDFCKLVKLRHLDLRCSDLKELPKDFCKLVKLRHLDLWGCDDLIGVPLGMDRLISLRVLPFFVVGRKEQSDDDELKALKGLTEIKGSIRIRIYSKYRIVEGMNDTGGAGYLKSMKHLTGVDITFDGGCVNPEAVLATLEPPSNIKRLEMWHYSGTTIPVWGRAEINWAISLSHLVDIQLWHCRNLQEMPVLSKLPHLKSLELYNLISLEYMESTSRSSSSDTEAATPELPTFFPSLEKLTLWRLDKLKGFGNRRSSSFPRLSKLEIWKCPDLTSFPSCPSLEELELKENNEALQIIVKITTTRGKEEKEEDKNAGVGNSQDDDNVKLRKVEIDNVSYLKSLPTNCLTHLDLTIRDSKEGEGEWEVGDAFQKCVSSLRSLTIIGNHGINKVKRLSGRTGLEHFTLLESLKLSDIEDQEDEGEDNIIFWKSFPQNLRSLRIKDSDKMTSLPMGMQYLTSLQTLYLHHCYELNSLPEWISSLSSLQSLHIGKCPALKSLPEAMRNLTSLQRLTIWQCPDLIERCKEPNGEDYPKIQHIPKIVLNKYW

SEQ ID NO: 43 - protein, 1188 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRGRGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTTRSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIELWMAQGYVVPLDGGQSIEDAAEEHFVILLRRCFFQDVKKDKYGDVDSVKIHDLMHDVAQEVGREELCVVNDNTKNLGDKIRHVHRDVIRYAQRVSLCSHSHKIRSYIGGNCEKRCVDTLIDKWMCLRMLDLSWSDVKNLPNSIGKLLHLRCLNLSYNKDLLILPDAITRLHNLQTLLLKECRSLKELPKDFCKLVKLRHLDLRCSDLKELPKDFCKLVKLRHLDLWGCDDLIGVPLGMDRLISLRVLPFFVVGRKEQSDDDELKALKGLTEIKGSIRIRIYSKYRIVEGMNDTGGAGYLKSMKHLTGVDITFDGGCVNPEAVLATLEPPSNIKRLEMWHYSGTTIPVWGRAEINWAISLSHLVDIQLWHCRNLQEMPVLSKLPHLKSLELYNLISLEYMESTSRSSSSDTEAATPELPTFFPSLEKLTLWRLDKLKGFGNRRSSSFPRLSKLEIWKCPDLTSFPSCPSLEELELKENNEALQIIVKITTTRGKEEKEEDKNAGVGNSQDDDNVKLRKVEIDNVSYLKSLPTNCLTHLDLTIRDSKEGEGEWEVGDAFQKCVSSLRSLTIIGNHGINKVKRLSGRTGLEHFTLLESLKLSDIEDQEDEGEDNIIFWKSFPQNLRSLRIKDSDKMTSLPMGMQYLTSLQTLYLHHCYELNSLPEWISSLSSLQSLHIGKCPALKSLPEAMRNLTSLQRLTIWQCPDLIERCKEPNGEDYPKIQHIPKILLNTSLILNAPNLQDMD

SEQ ID NO: 44 - DNA, 7111 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcatggtcggatgttaaaaatttgcctaattcaataggtaaattgttgcacttgaggtgtcttaacctgtcttataataaagatctgttgatactccctgatgcaattacaagactgcataatttgcagacactgcttttaaaagagtgcagaagtttaaaggagttgccaaaagatttttgcaaattggtcaaactgaggcacttggatttaaggtgttctgatttgaaggagttgccaaaagatttttgcaaattggtcaaactgaggcacttggatttatggggttgtgatgatttgattggtgtgccattgggaatggataggctaattagtcttagagtactgccattctttgtggtgggtaggaaggaacaaagtgatgatgatgagctgaaagccctaaaaggcctcaccgagataaaaggctccattcgtattagaatctattcaaagtatagaatagttgaaggcatgaatgacacaggaggagctgggtatttaaagagcatgaaacatctcacgggggttgatattacatttgatggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttagactttggcgtctggacaagttgaagggttttgggaacaggagatcgagtagttttccccgcctctctaaattggaaatctggaaatgcccagatctaacgtcatttccttcttgtccaagccttgaagagttggaattgaaagaaaacaatgaagcattgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatccctgcacataggaaaatgtccagccctaaaatcactaccagaagcaatgcggaacctcacctcccttcagagacttacgatatggcagtgtccagacctaattgaaagatgcaaagaacctaacggggaggactatcccaaaattcaacacatccccaaaattgtaagtcattgcagaaagtaatttattcatttatatttattttatgcttagaatgatatacaccgtcgtcctttggtttcaaatcttgaatttggtttttgttttctttctttgtttctttattcaacaccagcccatttatgattgattcattaaaaaaaggatggagttttgtggatttgaagaagacaacgaattgagattcctggggttttctttttgttggggttggatttcatgtatatgttgctgattaaatacgagactgatgatgatgatgatgtgtttatgggttttaaatcagattaaatatatgggaaatgtaagttaatttgggatgcacataaggtgtttgctgaaatgtctatgagaaatgttgtttcttggacttagaatgatatacactgtcgtccattggtttccaatcttacatttggtttgtgttttcttagtttgtttctttaatcaacaccaacccatttttttaaaactacctgcaactactaatttacgttgaccctgtatctcaggtactaaatgaatattggtgattttcagttactcaacactagcttgatcctgaacgcacccaaccttcaggttagaatccggcttactcatccttttgtccagttttcaagtaattgttttggcaggatcaattctctaattgttgtacaccgtatattgcaatttatagtgactacagttaatgaatgtttacaaaaaattagtcatgtaaaaacttcttctctgtccattacataaactctttttctctttctaacttatcatgttcatgtctaaaaaattaaacatgctcacatcaatgttcatttaagctaacttacttctgtaagagagcgagctagttaaaaactcctttaactttctgttttatactcaggacatggattgatgcaagcatgaagaacttcgggaatttgctaaaactctaccaaagcgatgagagtttggactttgtttcacttgaagtcagggactgtcaacaaagccacagtgtgcatgttggctgtttcacttggacgataaaaaggtttatttaattgttttcctaagtgtatttggcttacaagcttttacttttcgcttgaaagggtttttcttgttttaagctttttgaattagagtttcggttgaagtaagagtagtcgtattagtcttttactttgcaggagtctatgcctatataaggtaagactcgtatttgtaattttcagattatgcaattcaagttttcgagtgttttcttaaaaaaacatatcatacctgtgtgtagcataaagataaattctgatgctgtgcttcttgttatggctcacattggttttcattgtttggattgtttcacagggaagcagagaatacctggaacctgtaaaggacgctatatctatagcagctttcacaggccaagtaatataatgttctttatcaatcactcaatacctggagattgtttgaacacataattcacctctttttttccatctcaaattgcagacttttactgggatttgaatgacagcaaacatttgattgtcacgaggattgatctaactggtgaatgttgtgatcaccatattggtctttctcattcaaacaaacttgcataccgttcttttgaagtttgaagacaagcaggcgataatcaactcaggtcgaagctcatgtgcaggagagaatagaatatagaggagattatttttaaaagaaacgctcaaaggtattgtagcacctttcctatttgctactgcagtgatgtttttatttcttgtttgcagcgcttgtttctcatatttcaacctacttttagaaaaaaaaacatctccgaacataaccaaaaataaagttcccttatcagtgctttccctgctttcttctaaacaacatatacaattataaaccctttttctctcttacctttgttattcttccttgcttcattgagataacactctcctgtttttgttttgttgttagtcattacatggatatatcaaggacaacagttctgtagtccgtcaactgtggttaggaaggctaaactggagcacaataaccccatgtcaattgaatagtaaaggtgtgctatatcagtttcgtttggcttggcttacctgaaaaatggctggttatttatccttgtctctttctatgacgtgcagtggcttgttaatgtgtctcggacaacaattcctcactttccaagttccatacacgctgatgtaactatcttctgcagtctgttctttcatttttgccacgtgctctaattataactttttgtactcaataatcaactccttgtcccggtatttgcagagactacttaaacaggtaaagtgacaatcctggcgaagttgtctgtttcttagctctgaacccatcattcaggtaagattaagtatttaagaagaaattttgtttttacctaaaatgaatgatcttgtgtaactgcttgcttcttgcattaaataagaactttctgctgcatatgtgacagttacatccacaaaaaagttggaggtttgttcagggattggaaatgaaggtacttcagaattcctggaatgtttatgaatgctccagacttcagagtctttaatggaaaattcgagtcactaaaaaaacattattcctatcatcagagctttgaagttcctctatacaaggtcaactgagttcctctttgcctcttgtttaattgtatttacttgtaccttaattataatctgtatattgttttagttaagttctaaaacaggttattattcatcatttgtgcagcatattgctggaatcaagaatctagtgcttcttcttcctgacttcactgtcaaaatagcagttcccatgctggaaataagcgcgctagcaatgtaattgatgacatggatgttgctgcttctgagttttgatcataaaaagctgttatgtgtttcttgaatgtaatgaaggagaggagaaaactgaaaactcttggcaaaaacgtgaaattgcagtgcctcggggtggtagggatcacccggattcagttcagacgatacttttttcaacccggtttgttccggttttcagcttcgggttttccttgtacttttggggcacacatacaaggctacttcatgtttgagaaacctaattgaggctatcttgtagcaaatgcacaccacactctttctctcttctctccttttttcaccttccatttgtaaaaatcctcttttaaaggttaataaaaaaaagcttcaagtctcgtagggtggatgtaggtcacattgaccgaaccacggtaaactctttgtgttctttcttctctctttgtttctcatttttacggcaagtgtttatggttaaccatgcatcttagaatagcttaaggcattaacataataacatcaatgttctccaaagattcaccttacttgttgtacataatcacaatgttaagcctatgaaggtagaatgctctcatgatttggtttaaccaaaaaataaactctaaaataatacggagtaataaaaattggccataaattatttacaaagtttgatttttgtatagggtatcttg

SEQ ID NO: 45 - DNA, 2000 bp, Spinacia oleracea; identical to SEQ ID NO: 13

SEQ ID NO: 46 - DNA, 3534 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcatggtcggatgttaaaaatttgcctaattcaataggtaaattgttgcacttgaggtgtcttaacctgtcttataataaagatctgttgatactccctgatgcaattacaagactgcataatttgcagacactgcttttaaaagagtgcagaagtttaaaggagttgccaaaagatttttgcaaattggtcaaactgaggcacttggatttaaggtgttctgatttgaaggagttgccaaaagatttttgcaaattggtcaaactgaggcacttggatttatggggttgtgatgatttgattggtgtgccattgggaatggataggctaattagtcttagagtactgccattctttgtggtgggtaggaaggaacaaagtgatgatgatgagctgaaagccctaaaaggcctcaccgagataaaaggctccattcgtattagaatctattcaaagtatagaatagttgaaggcatgaatgacacaggaggagctgggtatttaaagagcatgaaacatctcacgggggttgatattacatttgatggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttagactttggcgtctggacaagttgaagggttttgggaacaggagatcgagtagttttccccgcctctctaaattggaaatctggaaatgcccagatctaacgtcatttccttcttgtccaagccttgaagagttggaattgaaagaaaacaatgaagcattgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatccctgcacataggaaaatgtccagccctaaaatcactaccagaagcaatgcggaacctcacctcccttcagagacttacgatatggcagtgtccagacctaattgaaagatgcaaagaacctaacggggaggactatcccaaaattcaacacatccccaaaattgtactaaatgaatattggtga

SEQ ID NO: 47 - DNA, 3567 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcatggtcggatgttaaaaatttgcctaattcaataggtaaattgttgcacttgaggtgtcttaacctgtcttataataaagatctgttgatactccctgatgcaattacaagactgcataatttgcagacactgcttttaaaagagtgcagaagtttaaaggagttgccaaaagatttttgcaaattggtcaaactgaggcacttggatttaaggtgttctgatttgaaggagttgccaaaagatttttgcaaattggtcaaactgaggcacttggatttatggggttgtgatgatttgattggtgtgccattgggaatggataggctaattagtcttagagtactgccattctttgtggtgggtaggaaggaacaaagtgatgatgatgagctgaaagccctaaaaggcctcaccgagataaaaggctccattcgtattagaatctattcaaagtatagaatagttgaaggcatgaatgacacaggaggagctgggtatttaaagagcatgaaacatctcacgggggttgatattacatttgatggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttagactttggcgtctggacaagttgaagggttttgggaacaggagatcgagtagttttccccgcctctctaaattggaaatctggaaatgcccagatctaacgtcatttccttcttgtccaagccttgaagagttggaattgaaagaaaacaatgaagcattgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatccctgcacataggaaaatgtccagccctaaaatcactaccagaagcaatgcggaacctcacctcccttcagagacttacgatatggcagtgtccagacctaattgaaagatgcaaagaacctaacggggaggactatcccaaaattcaacacatccccaaaattttactcaacactagcttgatcctgaacgcacccaaccttcaggacatggattga

SEQ ID NO: 48 - protein, 1177 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRGRGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTTRSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIELWMAQGYVVPLDGGQSIEDAAEEHFVILLRRCFFQDVKKDKYGDVDSVKIHDLMHDVAQEVGREELCVVNDNTKNLGDKIRHVHRDVIRYAQRVSLCSHSHKIRSYIGGNCEKRCVDTLIDKWMCLRMLDLSWSDVKNLPNSIGKLLHLRCLNLSYNKDLLILPDAITRLHNLQTLLLKECRSLKELPKDFCKLVKLRHLDLRCSDLKELPKDFCKLVKLRHLDLWGCDDLIGVPLGMDRLISLRVLPFFVVGRKEQSDDDELKALKGLTEIKGSIRIRIYSKYRIVEGMNDTGGAGYLKSMKHLTGVDITFDGGCVNPEAVLATLEPPSNIKRLEMWHYSGTTIPVWGRAEINWAISLSHLVDIQLWHCRNLQEMPVLSKLPHLKSLELYNLISLEYMESTSRSSSSDTEAATPELPTFFPSLEKLRLWRLDKLKGFGNRRSSSFPRLSKLEIWKCPDLTSFPSCPSLEELELKENNEALQIIVKITTTRGKEEKEEDKNAGVGNSQDDDNVKLRKVEIDNVSYLKSLPTNCLTHLDLTIRDSKEGEGEWEVGDAFQKCVSSLRSLTIIGNHGINKVKRLSGRTGLEHFTLLESLKLSDIEDQEDEGEDNIIFWKSFPQNLRSLRIKDSDKMTSLPMGMQYLTSLQTLYLHHCYELNSLPEWISSLSSLQSLHIGKCPALKSLPEAMRNLTSLQRLTIWQCPDLIERCKEPNGEDYPKIQHIPKIVLNEYW

SEQ ID NO: 49 - protein, 1188 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRGRGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTTRSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIELWMAQGYVVPLDGGQSIEDAAEEHFVILLRRCFFQDVKKDKYGDVDSVKIHDLMHDVAQEVGREELCVVNDNTKNLGDKIRHVHRDVIRYAQRVSLCSHSHKIRSYIGGNCEKRCVDTLIDKWMCLRMLDLSWSDVKNLPNSIGKLLHLRCLNLSYNKDLLILPDAITRLHNLQTLLLKECRSLKELPKDFCKLVKLRHLDLRCSDLKELPKDFCKLVKLRHLDLWGCDDLIGVPLGMDRLISLRVLPFFVVGRKEQSDDDELKALKGLTEIKGSIRIRIYSKYRIVEGMNDTGGAGYLKSMKHLTGVDITFDGGCVNPEAVLATLEPPSNIKRLEMWHYSGTTIPVWGRAEINWAISLSHLVDIQLWHCRNLQEMPVLSKLPHLKSLELYNLISLEYMESTSRSSSSDTEAATPELPTFFPSLEKLRLWRLDKLKGFGNRRSSSFPRLSKLEIWKCPDLTSFPSCPSLEELELKENNEALQIIVKITTTRGKEEKEEDKNAGVGNSQDDDNVKLRKVEIDNVSYLKSLPTNCLTHLDLTIRDSKEGEGEWEVGDAFQKCVSSLRSLTIIGNHGINKVKRLSGRTGLEHFTLLESLKLSDIEDQEDEGEDNIIFWKSFPQNLRSLRIKDSDKMTSLPMGMQYLTSLQTLYLHHCYELNSLPEWISSLSSLQSLHIGKCPALKSLPEAMRNLTSLQRLTIWQCPDLIERCKEPNGEDYPKIQHIPKILLNTSLILNAPNLQDMD

SEQ ID NO: 50 - DNA, 6025 bp, Spinacia oleracea
atggctgaaatcggatactcggtttgttcaaaacttattgaagtgatgggcagtaatatcattaaagagattcgcgacatgtggggttacaattctcatcttgaagacctcaacaaatctgtcttgacgatcaaggatgtgctcttggatgctgaggcgaagcgggatctttcccgtgaacaacagagttacattgcagaacttaaggatgttgtttacgatgctgatgatttgttcgatgagttcctcactcttgctgagctcaaacagattgatggaaacaagggtggtggtaaattctccaaaaaggtacgtcgtttcttttcttctaataaggagaagatgggtcaagcttacaagatgtctcatatggttaaagaaattaagaagcagttgggtgaaattgttgataggtataccaaatttgggtttattgttgattataaacctattattaggagaagggaggaaacatgttcttattttgtaggtgccaaggagattgttgggagggataaggataaagatgttatcataggcatgttgctagatcatgataacgattgtagtttcttggctgttgtgggggttggaggggtgggaaaaactactcttgcccaacttgtgtataatgatgaaagagtcaaaagtgagttccaagatttgaggtattgggtttgtgtctctgatcaagatgggggacaatttgatgacaaaagaattctttgtaagattatagagttagttacgggccagattcctccgagtaacgagagcatggaatcggtgcgtaagaaatttcaagaggaattaggaggaaagaagtacttccttgttcttgatgatgtatggaacgaggatcgccagaagtggcttcatctagaaaatttcttgaaattgggtcaagggggaagcaaggttgtggtaaccacacgttcagagaagacggcaaatgttatagggaaaagacaagactataaactagaatgtttgtcagcagaggattcatggcgcttatttgaaatgtcagcttttgacgaagggcatggccaggaaaactatgacgaattagtgacgattggcaagaagattgttgaaaaatgttataacaatccacttgctataacagtggtaggaagccttctttttggacaagagataaataagtggcggtcgtttgaaaacagtggattagcccaaattgccaatggtgataatcagattttcccgatattaaagctcagttaccacaatcttccacactccttgaagagctgctttagctattgtgcagtgtttcccaaagataatgaaataaagaaggagatgttgattgatctttggatagcacaaggatacattataccgttggatggaggtcaaagtatagaagatgctgccgaggaacattttgtaattttgttaagaagatgtttctttcaagatgtaaagaaggattctcttggtaatgttgattatgttaaaatccacgacttaatgcacgatgtcgctcaagaagtggggaaggaggaaatttgtgtagtgacttcaggtacaaagaagttggctgataaaatccgtcacgtgggttgtgttgtcgatagagatccagaaatagtctttttatgtagcaataagattcgttcgtatattagcggtcgttgtataaagaatccggtggattcacaaatagacaactggatgcgccttagggtgttggacttgtcagattcatgtgttaaagatttgtctgattcaataggtaagctgctgcacttaaggtatcttaacctctcttctaatataaagttggagataatccctgatgcaattacaagactgcataacttgcagacactacttttagaagattgcagaagtttaaaggagttgccaaaagatttttgcaaattggtcaaactgaggcacttggaattacagggttgtcatgatttgattggtatgccatttggaatggataagctaactagtcttagaatactaccaaacattgtggtgggtaggaaggaacaaagtgatgatgagctgaaagccctaaaaggcctcatcgagataaaaggctccatttctatcagaatctattcaaagtatagaatagttgaaggcatgaatgacacaggaggagctgcttatttgaagagcatgaaacatctcagggagattgatattacatttttgggtgaatgtgttagccctgaagctgtattggaaaccttagagccaccttcaaatatcaagagcttatatatatataattacagtggtacaacaattccagtatggggaagagcagagattaattgggcaatctccctctcacatctcgtcgacatccagcttagttgttgtagtaatttgcaggagatgccagtgctgagtaaactgcctcatttgaaatcgctgaaacttggatggttggataacttagagtacatggagagtagcagtagcagtgacacagaagcagcaacaccagaattaccaacattcttcccttcccttgaaaaacttactttacagcatctggaaaagttgaagggttttgggaacaggagatcgagtagttttccccgcctctctgaattggaaatcaagaaatgcccagatctaacgtcatttccttcttgtccaagccttgagaagttggaattgaaagaaagcaatgaagcgttgcaaataatagtaaaaataacaacaagaggtaaagaaaaagaagagaacaataatgctggtgttggaaattcacaagatgatgacaaagtcaaattacggaagatggtgatagacaatctgggttatctcaaatcactgcccacaaattgtcttactcaccttgaaattgaggagtttattgaatcagattccgaggaagagattgaatcagaagtcggggaggaggaggttgaattggaagttgtggaggcatttcagaagtctgcatcttctctgcaaagcctcgaaatatacagaataaataaactgaatagactaactggaacaacaggattagtgcatttcagtgccttggacgaactcacattgaattttgtcgacgattttgaagtatcctttcctcaaagcctccgcagtttgaaaattgaatactcttataaaatgacaagtctgcccatggggatgcagtacttaacctccctccaaaccctcgaactaaaatgttgtgatgaattgaattcccttccagaatggataagcaacttatcatctcttcaatccctgtccatatcctactgtgaagccctgaaatcactaccagaagcaatgcagaacctcacctcccttcagagacttgtgataagagaatgtcgagacctagctgaaagatgcgaagaacccaatggggaagactatcacaaaattcaacacatccccaaaattgtaagtgattgcggaaagtgtttcttttatttatttttaattttatgcttagaatgatatacatcagcattcagcgtccattggtttccaatcttacatttggtttttgtttcttagtttgtttctttaatcaacaccagcccattttttttaaactacctgcaactactaattttcatttaccctgtatctcaggaaatatggtagtattctcatttactcaacactagcttgatcctgaacgcagccaaccttcaggttagaatccgccttactcatccttttgtcatgcattgttttaagttgttttgcttgcttgtgtaatcataattcatagtatacgattcatcattcactatgtctacaggcaagatattggaattgttcacgattccctgaagtttctttgtttttgttgataccaccatattgcagcttatagtgactaagttaatgaatgtttccaaaaaattagtcatataaattcttcttctctctctattacataaactctttttctctttctaactatcatgttcatgtctaaaacttatacatgctcacatcattgttcgtttcagctgacttacttctgtaagagagctatctagttaacaactcttgtaacattttatttgctagtcagaacatggattggtgcaagcatgggaatttgccaacactctaccaaatcgattggagtttggacttagtttcaccagaagccatacccggacacttactggggactgtcaacaaagccgcattatgatgtacttggatgtttcacgtgcctgaggtgtgagttacttggaagggaagcggtttatttaattgttttcctaagtagattttgcttagaagcttttacttttcacttgaaagggtttttcttgttttaagcttttcgaattagagtttcggttgcattaagagtagtcgtattagtctttttttacctaaggaagacttttttgtaattttcagacgatgcaattcaacttttcgagtgttttgttgcttgtgtgattgtgagtttgtgaatttgtctttcataaatattgagttcatcagaagctttatgctccaccggtagtctagtaccttttgttattgttcagggaagtaatctggtaccttctatatatatgagaaaacatacattatgcaaaattcttacaggttagttacttcctagaacttcagttatactttttttttgttccatgtccttggaatcaagtcattccctctgaaaaatgtgtactgaacttttgaaagttgctgtttgattcctgtttgaatcttcacttttcttgcatcgtgacagctgtgtttacaatgaagtttaagcagacactctctttatatagtgcctccttttggagcatcggagagttgtggctgatcactatgtgcgaccaagagattcattaatcgcgtgtttgatcaggtaaaagtttttatgtcaatgtgttttatttttctttctgtttgatcagtttatgtctgtattcagattcttatcttcttctagtagcataacaaatttgtttgtttcattatataaaccgtttcaggattacaaatgatcggacagagatgtatgcttcagtcgatattgatgataacttaaggtagtattgctagaacagttacagagctgtggctgatcactatgtgctgcaaacagattcatcaatcacgtgtttgataaggtagagttttcatgtcaacgcgttttttctgtttgatcaatttatgtctgtattcagattcttatctacttctagtagcataacatatctgtttctatcattatataattgtttcagggttacaaatgaccggacagagatgtatgcttcagtcgatattgatgctaacttaagatagcattgctagaacagtttcaggttgccattgaaatttgaaaacagaaagacaccatcaggtagagttttcatgtcaatgctttttttttttttgatcaatttatgtttgtataaaaatttgtatcttcttctatactataaattctatataacgtatctgtttatttcattataataaaccgtttcaggattacaaatgatcgaacagtgatgtatgcttcagtcgataacttcaggtagcattgccagaagaattgcagacacatcctaacttaagagggttatggttgattgactaactctcgaaattctagttaggcaagaggagcattgcagtacctgccttaaaaggggtcgtcttatatagatatctctatcagtagtcatttacgtcttaagtcctgaaataagttgaactaaacatactttgtttgaatcgaagatttagtgaattttactttgtatttgattgtgttgagatgaccgtagggaaaagttaactaattataagcgtaaattatgttcttggattcggcttttatattttcttttcgtttaataaaagtggtcatagagatattctacaatgtattttggtaagttacctaaaatttaatttgattatttttcacataattaatcaactgataaaattttatttggatcaaccgatcaagaagtgaaaacgtaaagaacaaaaagaaacagaggga

SEQ ID NO: 51 - DNA, 2001 bp, Spinacia oleracea
aaaaaaaaattacttatttcttctatttttacttgttacacttttctacaacagaaacatcaaaacgcccgcaacacactataaatgaaaaaccattttgtatgcaatgatatttacgttctcactttattctctttaataactcctactacgtaattctcaccaatcaaataaaattatagaaattttcatttataccctcttaaaatgatgttgatttctttttttttttttttaaggtgtgaaaaagtttgtgttataagttacaacaatttaaaaacggagaacatacttataatactagtgtaatctttggccggattatggtcgttgacaaaaaaactccggccttgaccctccacgtgccggtcaagtgacttaataaaccttttattccacccttttttcattcttctttttattcttctttttctctccattaatacaaatcaagtgattatgtcgatccgatccttctgttctctactgtaattgattacaccaacaacaaccaagcgaaacagtcaatgttaccgaattgaattgcggaaaatagtttatgattgattcattaaaaaaggatggagttttgtggatttgaataagacaacgaattgagattcctggggttttctttctgttggggttggatttcatgtacttgttgatgatcaaatatgtgattgaagattgaagatgatgatgtgtttatgggtttgaaatcggattaaatttatgggaaatgtaagtgaattggggatgcacataaggtgtttgatgaaatgtctatgagaaatattgtttcttgcacttgtatgataatttgtggggatttgattagttcatggtgcgagtttgatgcaacgccgaagagaaatcaggtctttagagaaactcaaatggttgaataggcttccaacaatgttgtttcgtagtacactgccatgattgatagagaaggaagcagatgaaggagaaggctcatgtgaccggcacatgggtagtaagtcaacgccggaaatcgtggtcaacgtccaaaaccgagctaaggtaacatattggagtacaagtaattacaacaaaaagtgttacttccttgtacattattattttacttgaaatgctagttgtgtttgtgcatctgtggaactctaaattaattaattaacaatcaaccaaacaactttagtgtaaattggccaaccttttgccatcagccacagaaaagtgaaatatcaccccattattgcccattctgtatttgcacttttttttaaggcatagcacagccggttttccggatcttagctccgtctacattcggatccgatccatttcgcacaccttatttgtggtggatgagtctcccaacaagaatttctcgctcgaaactgagaacccccttaagcggcatcaagttgcttaccacttgagccaactctatgttggtttctgcatttgcagttagttaggtcgtctgagtgcgaaatgggaatgctttatcacacactccacagtttagtcaggctgatggaaacgtaataattgagttatttgagtgttcaaacttaaagtcactcactcactcaaacactcaatactttctccatcttgttttctcattacatatgaaaacccaaacacctttcatttctgcttaatcttctttctctcatctttcagttattcacctgttcatctttctgaaaacaacccaaacacccttcatttctgtttaatcttctttcctcatcttcatccacctgtttatctttctgtaaacacaacccaaacacctttcatttctgatttatcttgttatctcatcttcattcacctgttcatctttctgaaaatctaaacacccttcatttctgctaatcttcttttctcatctccccctaaatcatctttctgaaaacccaaacacctttcttttctgcttttatcttgttttctcatcttaattcatctcttcatctttctgaaaaacccaaccca

SEQ ID NO: 52 - DNA, 3429 bp, Spinacia oleracea
atggctgaaatcggatactcggtttgttcaaaacttattgaagtgatgggcagtaatatcattaaagagattcgcgacatgtggggttacaattctcatcttgaagacctcaacaaatctgtcttgacgatcaaggatgtgctcttggatgctgaggcgaagcgggatctttcccgtgaacaacagagttacattgcagaacttaaggatgttgtttacgatgctgatgatttgttcgatgagttcctcactcttgctgagctcaaacagattgatggaaacaagggtggtggtaaattctccaaaaaggtacgtcgtttcttttcttctaataaggagaagatgggtcaagcttacaagatgtctcatatggttaaagaaattaagaagcagttgggtgaaattgttgataggtataccaaatttgggtttattgttgattataaacctattattaggagaagggaggaaacatgttcttattttgtaggtgccaaggagattgttgggagggataaggataaagatgttatcataggcatgttgctagatcatgataacgattgtagtttcttggctgttgtgggggttggaggggtgggaaaaactactcttgcccaacttgtgtataatgatgaaagagtcaaaagtgagttccaagatttgaggtattgggtttgtgtctctgatcaagatgggggacaatttgatgacaaaagaattctttgtaagattatagagttagttacgggccagattcctccgagtaacgagagcatggaatcggtgcgtaagaaatttcaagaggaattaggaggaaagaagtacttccttgttcttgatgatgtatggaacgaggatcgccagaagtggcttcatctagaaaatttcttgaaattgggtcaagggggaagcaaggttgtggtaaccacacgttcagagaagacggcaaatgttatagggaaaagacaagactataaactagaatgtttgtcagcagaggattcatggcgcttatttgaaatgtcagcttttgacgaagggcatggccaggaaaactatgacgaattagtgacgattggcaagaagattgttgaaaaatgttataacaatccacttgctataacagtggtaggaagccttctttttggacaagagataaataagtggcggtcgtttgaaaacagtggattagcccaaattgccaatggtgataatcagattttcccgatattaaagctcagttaccacaatcttccacactccttgaagagctgctttagctattgtgcagtgtttcccaaagataatgaaataaagaaggagatgttgattgatctttggatagcacaaggatacattataccgttggatggaggtcaaagtatagaagatgctgccgaggaacattttgtaattttgttaagaagatgtttctttcaagatgtaaagaaggattctcttggtaatgttgattatgttaaaatccacgacttaatgcacgatgtcgctcaagaagtggggaaggaggaaatttgtgtagtgacttcaggtacaaagaagttggctgataaaatccgtcacgtgggttgtgttgtcgatagagatccagaaatagtctttttatgtagcaataagattcgttcgtatattagcggtcgttgtataaagaatccggtggattcacaaatagacaactggatgcgccttagggtgttggacttgtcagattcatgtgttaaagatttgtctgattcaataggtaagctgctgcacttaaggtatcttaacctctcttctaatataaagttggagataatccctgatgcaattacaagactgcataacttgcagacactacttttagaagattgcagaagtttaaaggagttgccaaaagatttttgcaaattggtcaaactgaggcacttggaattacagggttgtcatgatttgattggtatgccatttggaatggataagctaactagtcttagaatactaccaaacattgtggtgggtaggaaggaacaaagtgatgatgagctgaaagccctaaaaggcctcatcgagataaaaggctccatttctatcagaatctattcaaagtatagaatagttgaaggcatgaatgacacaggaggagctgcttatttgaagagcatgaaacatctcagggagattgatattacatttttgggtgaatgtgttagccctgaagctgtattggaaaccttagagccaccttcaaatatcaagagcttatatatatataattacagtggtacaacaattccagtatggggaagagcagagattaattgggcaatctccctctcacatctcgtcgacatccagcttagttgttgtagtaatttgcaggagatgccagtgctgagtaaactgcctcatttgaaatcgctgaaacttggatggttggataacttagagtacatggagagtagcagtagcagtgacacagaagcagcaacaccagaattaccaacattcttcccttcccttgaaaaacttactttacagcatctggaaaagttgaagggttttgggaacaggagatcgagtagttttccccgcctctctgaattggaaatcaagaaatgcccagatctaacgtcatttccttcttgtccaagccttgagaagttggaattgaaagaaagcaatgaagcgttgcaaataatagtaaaaataacaacaagaggtaaagaaaaagaagagaacaataatgctggtgttggaaattcacaagatgatgacaaagtcaaattacggaagatggtgatagacaatctgggttatctcaaatcactgcccacaaattgtcttactcaccttgaaattgaggagtttattgaatcagattccgaggaagagattgaatcagaagtcggggaggaggaggttgaattggaagttgtggaggcatttcagaagtctgcatcttctctgcaaagcctcgaaatatacagaataaataaactgaatagactaactggaacaacaggattagtgcatttcagtgccttggacgaactcacattgaattttgtcgacgattttgaagtatcctttcctcaaagcctccgcagtttgaaaattgaatactcttataaaatgacaagtctgcccatggggatgcagtacttaacctccctccaaaccctcgaactaaaatgttgtgatgaattgaattcccttccagaatggataagcaacttatcatctcttcaatccctgtccatatcctactgtgaagccctgaaatcactaccagaagcaatgcagaacctcacctcccttcagagacttgtgataagagaatgtcgagacctagctgaaagatgcgaagaacccaatggggaagactatcacaaaattcaacacatccccaaaattgaaatatggtag

SEQ ID NO: 53 - protein, 1142 aa, Spinacia oleracea
MAEIGYSVCSKLIEVMGSNIIKEIRDMWGYNSHLEDLNKSVLTIKDVLLDAEAKRDLSREQQSYIAELKDVVYDADDLFDEFLTLAELKQIDGNKGGGKFSKKVRRFFSSNKEKMGQAYKMSHMVKEIKKQLGEIVDRYTKFGFIVDYKPIIRRREETCSYFVGAKEIVGRDKDKDVIIGMLLDHDNDCSFLAVVGVGGVGKTTLAQLVYNDERVKSEFQDLRYWVCVSDQDGGQFDDKRILCKIIELVTGQIPPSNESMESVRKKFQEELGGKKYFLVLDDVWNEDRQKWLHLENFLKLGQGGSKVVVTTRSEKTANVIGKRQDYKLECLSAEDSWRLFEMSAFDEGHGQENYDELVTIGKKIVEKCYNNPLAITVVGSLLFGQEINKWRSFENSGLAQIANGDNQIFPILKLSYHNLPHSLKSCFSYCAVFPKDNEIKKEMLIDLWIAQGYIIPLDGGQSIEDAAEEHFVILLRRCFFQDVKKDSLGNVDYVKIHDLMHDVAQEVGKEEICVVTSGTKKLADKIRHVGCVVDRDPEIVFLCSNKIRSYISGRCIKNPVDSQIDNWMRLRVLDLSDSCVKDLSDSIGKLLHLRYLNLSSNIKLEIIPDAITRLHNLQTLLLEDCRSLKELPKDFCKLVKLRHLELQGCHDLIGMPFGMDKLTSLRILPNIVVGRKEQSDDELKALKGLIEIKGSISIRIYSKYRIVEGMNDTGGAAYLKSMKHLREIDITFLGECVSPEAVLETLEPPSNIKSLYIYNYSGTTIPVWGRAEINWAISLSHLVDIQLSCCSNLQEMPVLSKLPHLKSLKLGWLDNLEYMESSSSSDTEAATPELPTFFPSLEKLTLQHLEKLKGFGNRRSSSFPRLSELEIKKCPDLTSFPSCPSLEKLELKESNEALQIIVKITTRGKEKEENNNAGVGNSQDDDKVKLRKMVIDNLGYLKSLPTNCLTHLEIEEFIESDSEEEIESEVGEEEVELEVVEAFQKSASSLQSLEIYRINKLNRLTGTTGLVHFSALDELTLNFVDDFEVSFPQSLRSLKIEYSYKMTSLPMGMQYLTSLQTLELKCCDELNSLPEWISNLSSLQSLSISYCEALKSLPEAMQNLTSLQRLVIRECRDLAERCEEPNGEDYHKIQHIPKIEIW

SEQ ID NO: 54 - DNA, 7190 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcatggtcggatgttaaaaatttgcctaattcaataggtaaattgttgcacttgaggtgtcttaacctgtcttataataaagatctgttgatactccctgatgcaattacaagactgcataatttgcagacactgcttttaaaagagtgcagaagtttaaaggagttgccaaaagatttttgcaaattggtcaaactgaggcacttggatttaaggtgttctgatttgaaggagttgccaaaagatttttgcaaattggtcaaactgaggcacttggatttatggggttgtgatgatttgattggtgtgccattgggaatggataggctaattagtcttagagtactgccattctttgtggtgggtaggaaggaacaaagtgatgatgatgagctgaaagccctaaaaggcctcaccgagataaaaggctccattcgtattagaatctattcaaagtatagaatagttgaaggcatgaatgacacaggaggagctgggtatttaaagagcatgaaacatctcacgggggttgatattacatttgatggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttagactttggcgtctggacaagttgaagggttttgggaacaggagatcgagtagttttccccgcctctctaaattggaaatctggaaatgcccagatctaacgtcatttccttcttgtccaagccttgaagagttggaattgaaagaaaacaatgaagcattgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatccctgcacataggaaaatgtccagccctaaaatcactaccagaagcaatgcggaacctcacctcccttcagagacttacgatatggcagtgtccagacctaattgaaagatgcgaagaacccaacggcgaggactatcccaaaattcaacacatccccaaaattgtaagtcattgcagaaagtaatttattcatttatatttattttatgcttagaatgatatacaccgtcgtcctttggtttcaaatcttgaatttggtttttgttttctttctttgtttctttattcaacaccagcccatttatgattgattcattaaaaaaaggatggagttttgtggatttgaagaagacaacgaattgagattcctggggttttctttttgttggggttggatttcatgtatatgttgctgattaaatacgagactgatgatgatgatgatgatgtgtttatgggttttaaatcagattaaatatatgggaaatgtaagttaatttgggatgcacataaggtgtttgctgaaatgtctatgagaaatgttgtttcttggacttagaatgatatacactgtcgtccattggtttccaatcttacatttggtttgtgttttcttagtttgtttctttaatcaacaccaacccatttttttaaaactacctgcaactactaatttacgttgaccctgtatctcaggtactaaatgaatattggtgattttcagttactcaacactagcttgatcctgaacgcacccaaccttcaggttagaatccggcttactcatccttttgtccagttttcaagtaattgttttggcaggatcaattctctaattgttgtacaccgtatattgcaatttatagtgactacagttaatgaatgtttacaaaaaattagtcatgtaaaaacttcttctctgtccattacataaactctttttctctttctaacttatcatgttcatgtctaaaaaattaaacatgctcacatcaatgttcatttaagctaacttacttctgtaagagagcgagctagttaaaaactcctttaactttctgttttatactcaggacatggattgatgcaagcatgaagaacttcgggaatttgctaaaactctaccaaagcgatgagagtttggactttgtttcacttgaagtcagggactgtcaacaaagccacagtgtgcatgttggctgtttcacttggacgataaaaaggtttatttaattgttttcctaagtgtatttggcttacaagcttttacttttcgcttgaaagggtttttcttgttttaagctttttgaattagagtttcggttgaagtaagagtagtcgtattagtcttttactttgcaggagtctatgcctatataaggtaagactcgtatttgtaattttcagattatgcaattcaagttttcgagtgttttcttaaaaaaacatatcatacctgtgtgtagcataaagataaattctgatgctgtgcttcttgttatggctcacattggttttcattgtttggattgtttcacagggaagcagagaatacctggaacctgtaaaggacgctatatctatagcagctttcacaggccaagtaatataatgttctttatcaatcactcaatacctggagattgtttgaacacataattcacctctttttttccatctcaaattgcagacttttactgggatttgaatgacagcaaacatttgattgtcacgaggattgatctaactggtgaatgttgtgatcaccatattggtctttctcattcaaacaaacttgcataccgttcttttgaagtttgaagacaagcaggcgataatcaactcaggtcgaagctcatgtgcaggagagaatagaatatagaggagattatttttaaaagaaacgctcaaaggtattgtagcacctttcctatttgctactgcagtgatgtttttatttcttgtttgcagcgcttgtttctcatatttcaacctacttttagaaaaaaaaacatctccgaacataaccaaaaataaagttcccttatcagtgctttccctgctttcttctaaacaacatatacaattataaaccctttttctctcttacctttgttattcttccttgcttcattgagataacactctcctgtttttgttttgttgttagtcattacatggatatatcaaggacaacagttctgtagtccgtcaactgtggttaggaaggctaaactggagcacaataaccccatgtcaattgaatagtaaaggtgtgctatatcagtttcgtttggcttggcttacctgaaaaatggctggttatttatccttgtctctttctatgacgtgcagtggcttgttaatgtgtctcggacaacaattcctcactttccaagttccatacacgctgatgtaactatcttctgcagtctgttctttcatttttgccacgtgctctaattataactttttgtactcaataatcaactccttgtcccggtatttgcagagactacttaaacaggtaaagtgacaatcctggcgaagttgtctgtttcttagctctgaacccatcattcaggtaagattaagtatttaagaagaaattttgtttttacctaaaatgaatgatcttgtgtaactgcttgcttcttgcattaaataagaactttctgctgcatatgtgacagttacatccacaaaaaagttggaggtttgttcagggattggaaatgaaggtacttcagaattcctggaatgtttatgaatgctccagacttcagagtctttaatggaaaattcgagtcactaaaaaaacattattcctatcatcagagctttgaagttcctctatacaaggtcaactgagttcctctttgcctcttgtttaattgtatttacttgtaccttaattataatctgtatattgttttagttaagttctaaaacaggttattattcatcatttgtgcagcatattgctggaatcaagaatctagtgcttcttcttcctgacttcactgtcaaaatagcagttcccatgctggaaataagcgcgctagcaatgtaattgatgacatggatgttgctgcttctgagttttgatcataaaaagctgttatgtgtttcttgaatgtaatgaaggagaggagaaaactgaaaactcttggcaaaaacgtgaaattgcagtgcctcggggtggtagggatcacccggattcagttcagacgatacttttttcaacccggtttgttccggttttcagcttcgggttttccttgtacttttggggcacacatacaaggctacttcatgtttgagaaacctaattgaggctatcttgtagcaaatgcacaccacactctttctctcttctctccttttttcaccttccatttgtaaaaatcctcttttaaaggttaataaaaaaaagcttcaagtctcgtagggtggatgtaggtcacattgaccgaaccacggtaaactctttgtgttctttcttctctctttgtttctcatttttacggcaagtgtttatggttaaccatgcatcttagaatagcttaaggcattaacataataacatcaatgttctccaaagattcaccttacttgttgtacataatcacaatgttaagcctatgaaggtagaatgctctcatgatttggtttaaccaaaaaataaactctaaaataatacggagtaataaaaattggccataaattatttacaaagtttgatttttgtatagggtatcttgtacttgtgataaaaaaaattaaaaaaaaaaaaattacttatttcttctatttttacttgttacacttttctacaac

SEQ ID NO: 55 - DNA, 2000 bp, Spinacia oleracea
tgcacagtgcctttagcggtattgaactattaacctcgaggttggaaagtataattcttatcacgactctttgaagttaggcttaacttgctcaccgattcttaaatagacccggcttatactaaatttattgtgtactatgcctagaaagtaaggtcaacaactttcttctaaatttttttggcatgtttataagggttattatgaaaaacatatcaaattggtgttgttagttaggcttgaataatatagacttttaaaaaattaggctaatttgatttaaaaaattgttacatatctaagaaaattgatgttaaatttatcagtcactgtataaacaataaaagtcaatatgtatgtaaaagggttgttagataaaatttttggctttttggtccacagtaagaggaactccaatgcttagttacaaggtggtgtagttaaatttgctacaaggttgtgtagttaaagagtaactccaatatattatagttaaatttaccacattaaatttctagctacaatatatttaagctataaagtttctcattggttgactataatacgttatagcaccttataatattttatttaatatacaattttatgtattttaccttttttacatttttttcgtgatctacctgctcagatgagccacactaatttggtagctgcttatacaattcttgtatcaacggttggctacttgttcaaatatttttatttttttacgagtaagtcattttatgatcattgaagttgctctaatattatcatggacctattaacgcatgaataattaactcggtaggaattagtttcaaaataaaattcccctcacaaaaaaatcagaaaaccaaccttctccagtttactgttgtctaaagccaaagagcatggaattttccagtaatcgcagaccccaaattctcttctccaatcgtccctgtcaatttcagcaattgaataaatcgttgattttaggatttgccgccaaaaaaatgaaaaatccatgaattttagggttcaaatttgatccgtaattgggaaaattttcagcaattgatcttccaaatcattcatacttgtttccagactgcaaatgaaaggtgcgaactttatactgcattttgattttccattactgtaatttattaagatgaactgcattttgcaattgttttattcgactactcatctttaaatcaaattgctaaattgctagctaattttcttatcatattgccaaaaatttgttgcttaaatgattccatttctctaattatttttgttttattggtagataaataattaaatatcagccccattaattgaatattcaaaggaaatgtatggtccaaaaatggcgtttaatagtcaatgccgtgttttatggggtggtggagtactatatgactgtgtgtggacttggagaagactagagagtattgattatcaaaatatggaccctgaaaatgaaaatgaaaatgaaaatgatgtttttacactttaaaatcgtcaaaaaacaaaaatcctccttagcaatagtatttacacgtgctatttgcacggacttcaatgcaatagtgtaaatttacggtcaaagttttcattctaaagcgtaaataactttcatgaatggaggacggtagtataagtataacgttatagcctacaattttcttatcatattcatataaatttgtttctaaaagttgttttacttggctaaaatacttttgttcttattggcagataaacatcagtccattattggccaacttgctgagtccattattggccaacttgaacatatacctccaaacaataatcaataatgtcgattatgaagtttgtgaatgcaatttattatcactttcatttataaaatgactacttgattaacacatacaatattacctttctccaaacaccctttcaattctgcttaatcttgttttctcatcatctcttcatctttctgaaaacacaaccca

SEQ ID NO: 56 - DNA, 3534 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcatggtcggatgttaaaaatttgcctaattcaataggtaaattgttgcacttgaggtgtcttaacctgtcttataataaagatctgttgatactccctgatgcaattacaagactgcataatttgcagacactgcttttaaaagagtgcagaagtttaaaggagttgccaaaagatttttgcaaattggtcaaactgaggcacttggatttaaggtgttctgatttgaaggagttgccaaaagatttttgcaaattggtcaaactgaggcacttggatttatggggttgtgatgatttgattggtgtgccattgggaatggataggctaattagtcttagagtactgccattctttgtggtgggtaggaaggaacaaagtgatgatgatgagctgaaagccctaaaaggcctcaccgagataaaaggctccattcgtattagaatctattcaaagtatagaatagttgaaggcatgaatgacacaggaggagctgggtatttaaagagcatgaaacatctcacgggggttgatattacatttgatggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttagactttggcgtctggacaagttgaagggttttgggaacaggagatcgagtagttttccccgcctctctaaattggaaatctggaaatgcccagatctaacgtcatttccttcttgtccaagccttgaagagttggaattgaaagaaaacaatgaagcattgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatccctgcacataggaaaatgtccagccctaaaatcactaccagaagcaatgcggaacctcacctcccttcagagacttacgatatggcagtgtccagacctaattgaaagatgcgaagaacccaacggcgaggactatcccaaaattcaacacatccccaaaattgtactaaatgaatattggtga

SEQ ID NO: 57 - DNA, 3567 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcatggtcggatgttaaaaatttgcctaattcaataggtaaattgttgcacttgaggtgtcttaacctgtcttataataaagatctgttgatactccctgatgcaattacaagactgcataatttgcagacactgcttttaaaagagtgcagaagtttaaaggagttgccaaaagatttttgcaaattggtcaaactgaggcacttggatttaaggtgttctgatttgaaggagttgccaaaagatttttgcaaattggtcaaactgaggcacttggatttatggggttgtgatgatttgattggtgtgccattgggaatggataggctaattagtcttagagtactgccattctttgtggtgggtaggaaggaacaaagtgatgatgatgagctgaaagccctaaaaggcctcaccgagataaaaggctccattcgtattagaatctattcaaagtatagaatagttgaaggcatgaatgacacaggaggagctgggtatttaaagagcatgaaacatctcacgggggttgatattacatttgatggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttagactttggcgtctggacaagttgaagggttttgggaacaggagatcgagtagttttccccgcctctctaaattggaaatctggaaatgcccagatctaacgtcatttccttcttgtccaagccttgaagagttggaattgaaagaaaacaatgaagcattgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatccctgcacataggaaaatgtccagccctaaaatcactaccagaagcaatgcggaacctcacctcccttcagagacttacgatatggcagtgtccagacctaattgaaagatgcgaagaacccaacggcgaggactatcccaaaattcaacacatccccaaaattttactcaacactagcttgatcctgaacgcacccaaccttcaggacatggattga

SEQ ID NO: 58 - protein, 1177 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRGRGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTTRSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIELWMAQGYVVPLDGGQSIEDAAEEHFVILLRRCFFQDVKKDKYGDVDSVKIHDLMHDVAQEVGREELCVVNDNTKNLGDKIRHVHRDVIRYAQRVSLCSHSHKIRSYIGGNCEKRCVDTLIDKWMCLRMLDLSWSDVKNLPNSIGKLLHLRCLNLSYNKDLLILPDAITRLHNLQTLLLKECRSLKELPKDFCKLVKLRHLDLRCSDLKELPKDFCKLVKLRHLDLWGCDDLIGVPLGMDRLISLRVLPFFVVGRKEQSDDDELKALKGLTEIKGSIRIRIYSKYRIVEGMNDTGGAGYLKSMKHLTGVDITFDGGCVNPEAVLATLEPPSNIKRLEMWHYSGTTIPVWGRAEINWAISLSHLVDIQLWHCRNLQEMPVLSKLPHLKSLELYNLISLEYMESTSRSSSSDTEAATPELPTFFPSLEKLRLWRLDKLKGFGNRRSSSFPRLSKLEIWKCPDLTSFPSCPSLEELELKENNEALQIIVKITTTRGKEEKEEDKNAGVGNSQDDDNVKLRKVEIDNVSYLKSLPTNCLTHLDLTIRDSKEGEGEWEVGDAFQKCVSSLRSLTIIGNHGINKVKRLSGRTGLEHFTLLESLKLSDIEDQEDEGEDNIIFWKSFPQNLRSLRIKDSDKMTSLPMGMQYLTSLQTLYLHHCYELNSLPEWISSLSSLQSLHIGKCPALKSLPEAMRNLTSLQRLTIWQCPDLIERCEEPNGEDYPKIQHIPKIVLNEYW

SEQ ID NO: 59 - protein, 1188 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRGRGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTTRSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIELWMAQGYVVPLDGGQSIEDAAEEHFVILLRRCFFQDVKKDKYGDVDSVKIHDLMHDVAQEVGREELCVVNDNTKNLGDKIRHVHRDVIRYAQRVSLCSHSHKIRSYIGGNCEKRCVDTLIDKWMCLRMLDLSWSDVKNLPNSIGKLLHLRCLNLSYNKDLLILPDAITRLHNLQTLLLKECRSLKELPKDFCKLVKLRHLDLRCSDLKELPKDFCKLVKLRHLDLWGCDDLIGVPLGMDRLISLRVLPFFVVGRKEQSDDDELKALKGLTEIKGSIRIRIYSKYRIVEGMNDTGGAGYLKSMKHLTGVDITFDGGCVNPEAVLATLEPPSNIKRLEMWHYSGTTIPVWGRAEINWAISLSHLVDIQLWHCRNLQEMPVLSKLPHLKSLELYNLISLEYMESTSRSSSSDTEAATPELPTFFPSLEKLRLWRLDKLKGFGNRRSSSFPRLSKLEIWKCPDLTSFPSCPSLEELELKENNEALQIIVKITTTRGKEEKEEDKNAGVGNSQDDDNVKLRKVEIDNVSYLKSLPTNCLTHLDLTIRDSKEGEGEWEVGDAFQKCVSSLRSLTIIGNHGINKVKRLSGRTGLEHFTLLESLKLSDIEDQEDEGEDNIIFWKSFPQNLRSLRIKDSDKMTSLPMGMQYLTSLQTLYLHHCYELNSLPEWISSLSSLQSLHIGKCPALKSLPEAMRNLTSLQRLTIWQCPDLIERCEEPNGEDYPKIQHIPKILLNTSLILNAPNLQDMD

SEQ ID NO: 60 - DNA, 6704 bp, Spinacia oleracea
atggccgaaatcggatactcggtttgtgcgaaactcatcgaagtgattggcagtgagctgatcaaagagatttgcgacacatggggttacaaatctcttcttgaggacctcaacaaaactgtattgacggtcaggaacgttctcattcaggccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaagggggaacgagagggaaacacgttcatatatagatgtcaagaatattcttgggagggataaagataagaatgatatcattgataggttgcttaatcgtaatgataatgaagcttgtagtttcctgaccatagtgggagcgggaggattgggaaaaactgctcttgcccaacttgtgttcaatgatgaaagggtcaaaattgagtttcatgatttgaggtattgggtttgtgtctctgatcaagatgggggccaatttgatgtgaaagaaatcctttgtaagattttagaggtggttactaaggagaaagttgataatagttccgcattggaattggtacaaagccaatttcaagagaagttaagaggaaagaagtacttccttgttcttgatgatgtatggaacgaggatcgtgagaagtggtttaaattggaagagttgttaatgttgggtcaagggggaagcaaggttgtagtgaccgcacgttcagagaagacagcaaatgtcatagggaaaagacatttttatacactggaatgtttgtcgccagattattcatggagcttatttgaaatgtcggcttttcagaaagggcatgagcaggaaaaccatgacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataacaagattttgtcgatattgaagctcagttactacaatcttgcaaactctttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtagtgaaggatgaatacggtgatgttgattctgttaaaatccacgacttgatgcacgatgtcgcccaagaagtgggcagagaggaaatctgtatagtgaatgctaatacaaagaacttgggtgataaaatccgtcatgtacatggtgatgtcaatagatatgcacaaagagtctctctgtgtagccataagattcgttcgtatattggtggtaattgtgaaaaacgttgggtggatacactaatagacaagtggatgtgtcttaggatgttggacttgtcaaggtcggatgttaaaaatttgcctaattcaataggtaaactattgcacttaaggtatcttaacctgtccggtaatagaaagttggagatactccctgatgcgattacaaaactgcataatttgcagacacttcttttagaaggttgcggaagtttaaaggagttgccaaaagatttttgcaaattggtcaaactgagacacttggatttatggggttgtgatgatttgattggtatgccattgggaatggatatgctaactagtcttagagtactgccatactttgtggtgggtaggaagaaacaaagtgttgatgatgagctgaaagccctaaaaggcctcaccgagataaaaggcgacattgatatcaaaatctgttccaattatagaatagttgaaggcatgaatgacacaggaggagctgggtatttgaagagcatgaaacatctcacgggggttgatattacatttgatggtggatgtgttaaccctgaagctgtgttggcaaccctagagccaccttcaaatatcaagagcttatctatagataattacgatggtacaacaattccagtatggggaagagcagagattaattgggcaatctccctctcacatcttgtcgacatttggttttgggattgtagtgatttgcaggagatgccagtgctgagtaaactgcctcatttgaaatcactggaactttttaagttttgtaagttagagtacatggagagtagaagcagcagcagtagcagtgacacagaagcagcaacaccagaattaccaacattcttcccttcccttgaaaaacttacactttggtatctggaaaagttgaagggtttggggaacaggagatcgagtagttttccccgcctctctgaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatctgggttatctcaaatcactgcccacaaattgtctgactcacctcgacattacaataagagattccaaggagggggagggtgaatgggaagttggggaggcatttcagaagtgtgtatcttctttgagaaagctcagcataatcggaaatcacggaataaataaagtgaagagactgtctggaagaacagggttggagcatttcactctgttggactcactcaaattttcagatatagacgaccaggaagatgagggcgaagacaacatcatattctggaaatcctttcctcaaaaccttcgcagtttgagaattgaagactctgacaaaatgacaagtttgcccatggggatgcagtacttaacctccctccaaaccctctatctatcatattgtgatgaattgaattcccttccagaatggataagcagcttatcatctcttcaatccctgttcatatacaattgtccagccctgaaatcactaccagaagcaatgaagaacctcacctcccttcagagacttgagatacatcattgtccagacctagctgaaagatgcagaaaacccaacggggaggactatcccaaaattcaacacatccccggcattgtaagtgattgcagaaagtattttattcatttatatttattttatgcttagaatgatatacgcagtcgtccttaggtttccaatcttgaatttggtttttgttttctttctttgtttctttattcaacaccagcccatttatgattgattcattaaaaaaaggaagaagacaacgaattgagattcctggggtttttttttcgttggggttggttttcatgtatatgttgctgattaaataccagactgatgatgatgatgtgtttatgggttttaaatcagattaaatatatgggaaatgtaagttagttggggatgcacataaggtgtttgatgaaatgtctattagaaatgttgtttcttggacttagaatgatatacactgtcgtcctttggtttccaatcttacatttggtttgtgttttcttagtttgtttctttaatcaacaccagcccattttttttaaactacctgcaactactaattttcatttaccctgtatctcaggaactatggcggtaattctcatttactcaacactaagcttgatcctgaacgcagccaaccttcaggttagaatctgccttactcatccttttgtcatgcattgttttaagttgttttgcttgcttgtgtaatcataattcatagtatacgattcatcattcactatgtctacaggcaagatattggaattgttcacgattccctgaagtttctttgtttttgttgataccaccatattgcagcttatagtgactaagttaatgaatgtttccaaaaaattagtcatataaattcttcttctctctctattacataaactctttttctctttctaacttatcatgttcatgtctaaaacttatacatgctcacatcattgttcgtttcagctgacttacttctgtaagagagctatctagttaacaactcttgtaacattttatttgctagtcagaacatggattggtgcaagcatgggaatttgccaacactctaccaaatcgattggagtttggacttagtttcaccagaagccatacccggacacttactggggactgtcaacaaagccgcattatgatgtacttggatgtttcacgtgcctgaggtgtgagttacttggaagggaagcggtttatttaattgttttcctaagtagattttgcttagaagcttttacttttcacttgaaagggtttttcttgttttaagcttttcgaattagagtttcggttgcattaagagtagtcgtattagtctttttttacctaaggaagacttttttgtaattttcagacgatgcaattcaacttttcgagtgttttgttgcttgtgtgattgtgagtttgtgaatttgtctttcataaatattgagttcatcagaagctttatgctccaccggtagtctagtaccttttgttattgttcagggaagtaatctggtaccttctatatatatgagaaaacatacattatgcaaaattcttacaggttagttacttcctagaacttcagttatactttttttttgttccatgtccttggaatcaagtcattccctctgaaaaatgtgtactgaacttttgaaagttgctgtttgattcctgtttgaatcttcacttttcttgcatcgtgacagctgtgtttacaatgaagtttaagcagacactctctttatatagtgcctccttttggagcatcggagagttgtggctgatcactatgtgctaccaagagattcattaatcgcgtgtttgatcaggtaaaagtttttatgtcaatgtgttttatttttctttctgtttgatcagtttatgtctgtattcagattcttatcttcttctagtagcataacaaatttgtttgtttcatttatataaaccgtttcaggattacaaatgatcggacagagatgtatgcttcagtcgatattgatgataacttaaggtagcattgctagaacagttacagagctgtggctgatcactatgtgctgcaaacagattcatcaatcacgtgtttgataaggtagagttttcatgtcaacgcgtgttttctgtttgatcaatttatgtctgtattcagattcttatctacttctagtagcataacatatctgtttctatcattatataattgtttcagggttacaaatgaccggacagagatgtatgcttcagtcgatattgatgctaacttaagatagcattgctagaacagtttcaggttgccattaatttgaaaacagaaagacaccatcaggtagagttttcatgtcaatgcttttttttttgtttgatcaatttatgtttgtataaaaatttgtatcttcttctatactataaattctatataacgtatctgtttatttcattataataaaccgtttcaggattacaaatgatcgaacagtgatgtatgcttcagtcgataacttcaggtagcattgccagaagaattgcagacacatcctaacttaagagggttatggttgattgactaactctcgaaattctagttaggcaagaggagcattgcagtacctgccttaaaaggggtcgtcttatatagatatctctatcagtagtcatttacgtcttaagtcctgaaataagttgaactaaacatactttgtttgaatcgaagatttagtgaattttactttgtatttgattgtgttgagatgaccgtagggaaaagttaactaattaagcgtaaattatgttcttggattcggcttttatattttcttttcgtttaataaaagtggtcatagagatattctacaatgtattttggtaagttacctaaaatttaatttgattatttttcacataattaatcaactgataaaattttatttggatcaaccgatcaagaagtgaaaacgtaaagaacaaaaagaaacagagggagtatattattatcttttacttttgatagtgaaggatgttatgatattttaactcaatcccttacaaaatatactggttaaatttcttaacaatgtagtactttggcaacaagttcaggttgaaagctttgagaaatagagttaggaaacataagaatcacaaaatttatgcttctctcatctgtgaatcaaaacacaaattcttatttacaaaggttgtacaataattattgtacaccgaagtaaaagttaactcaaaatgcttaaaagttaggcttatatatgtaaaagttatctattgtttagtgataaaaaatttcattttaataaaacttattttttcaa

SEQ ID NO: 61 - DNA, 2000 bp, Spinacia oleracea
  unsure 841..871
tagcattgttcgttctgatttttacggcactgatatccctcatttgcagctctacttctagaaactctttcattctttagttttccttttgattcatgtaacagttgaaccttctttcatgactgatatagaatcaggcagctacttcactacttctatgttgatcttattttgtaataaactttgatagattgaataaaggttgtttgcagtgacttcttaagatgtgattagaagtccataatcactttaaggtagtttttctttacatgattaaggtttttccgaggcctttctattgctttgttggttactgtcatgacatatggtttttctttgcttcttatatcatatggtcctcactcaattttttaatataaagtttctcattggttgactataatacgttatagcaccttataatattttatttaatatacaattttatgtattttacctttttcatattttttcgtgatctaccttctcatatgagctacactaatttggtagctgtttatgcaaatcttgtaccaacggttggctatttgctcaaaattttttttttttttttcgagctagtcattttatgatcattgaagtttgctcttatattatcatttatgtattttaccttttttacatttttttcgtgatctacctgctcatatgagccacactaatttggtagctgcttatacaattcttgtatcaacggttggctacttgttcaaatatttttatttttttacgagtaagtcattttatgatcattgaagttgctctaatattatcatggacctattaacgcatgaataattaactcggtaggaattagttnnnnnnnnnnnnnnnnnnnnnnnnnnnnnnnaaaaaaaaatcagaaaaccaaccttctccagtttactgttgtctaaagccaaagagcatggaattttccagtaatcgcagaccccaaattctcttctccaatcgtccctgtcaatttcagcaattgaatcaatcgttgattttaggatttgccgccaaaaaaatgaaaaatccatgaattttagggttcaaatttgatccgtaattgggaaaattttcagcaattgatcttccaaatcattcatacttgtttccagactgcaaatgaaaggtgcgaactttatactgcattttgattttccattactgtaatttattaagatgaactgcaatttgcaattgttttattcgactactcatctttaaatcaaattgctaaattgctagctaattttcttatcatattgccaaaaatttgttgcttaaatgattccatttctctaattatttttgttttattggtagataaataattaaatatcagccccattaattgaatattcaaaggaaatgtatggtccaaaaatggcgtttaatagtcaatgccgtgttttatggggtggtggagtactatatgactgtgtgtggacttggagaagactagagagtattgattatcaaaatatggaccctgaaaatgaaaatgaaaatgatgtttttacactttaaaatcgtcaagaaacaacaatcctctttagcaatagtatttacacgcgttatttgcacggacttcaatgcaaatagtataaatttacagtcaaagttttcattctaaagcgtaaataactttcatgaatggaggacggtagtataagtataacgttatggcctaccattttcttatcatattcacataaatttgttgctaaaagttgttttacttggctaaaatacttttgttcttattggcagataaacatcagtccattattggccaacttgaacatatacctccaaacaataatcaataatgtcgattatgaagtttgtgaatgcaatttattatcactttcatttataaaatgactacttgattaacacatacaatattacctttctccaaacaccctttcaattctgcttaatcttgttttctcatcatctcttcatctttctgaaaacacaaccca

SEQ ID NO: 62 - DNA, 3453 bp, Spinacia oleracea
atggccgaaatcggatactcggtttgtgcgaaactcatcgaagtgattggcagtgagctgatcaaagagatttgcgacacatggggttacaaatctcttcttgaggacctcaacaaaactgtattgacggtcaggaacgttctcattcaggccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaagggggaacgagagggaaacacgttcatatatagatgtcaagaatattcttgggagggataaagataagaatgatatcattgataggttgcttaatcgtaatgataatgaagcttgtagtttcctgaccatagtgggagcgggaggattgggaaaaactgctcttgcccaacttgtgttcaatgatgaaagggtcaaaattgagtttcatgatttgaggtattgggtttgtgtctctgatcaagatgggggccaatttgatgtgaaagaaatcctttgtaagattttagaggtggttactaaggagaaagttgataatagttccgcattggaattggtacaaagccaatttcaagagaagttaagaggaaagaagtacttccttgttcttgatgatgtatggaacgaggatcgtgagaagtggtttaaattggaagagttgttaatgttgggtcaagggggaagcaaggttgtagtgaccgcacgttcagagaagacagcaaatgtcatagggaaaagacatttttatacactggaatgtttgtcgccagattattcatggagcttatttgaaatgtcggcttttcagaaagggcatgagcaggaaaaccatgacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataacaagattttgtcgatattgaagctcagttactacaatcttgcaaactctttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtagtgaaggatgaatacggtgatgttgattctgttaaaatccacgacttgatgcacgatgtcgcccaagaagtgggcagagaggaaatctgtatagtgaatgctaatacaaagaacttgggtgataaaatccgtcatgtacatggtgatgtcaatagatatgcacaaagagtctctctgtgtagccataagattcgttcgtatattggtggtaattgtgaaaaacgttgggtggatacactaatagacaagtggatgtgtcttaggatgttggacttgtcaaggtcggatgttaaaaatttgcctaattcaataggtaaactattgcacttaaggtatcttaacctgtccggtaatagaaagttggagatactccctgatgcgattacaaaactgcataatttgcagacacttcttttagaaggttgcggaagtttaaaggagttgccaaaagatttttgcaaattggtcaaactgagacacttggatttatggggttgtgatgatttgattggtatgccattgggaatggatatgctaactagtcttagagtactgccatactttgtggtgggtaggaagaaacaaagtgttgatgatgagctgaaagccctaaaaggcctcaccgagataaaaggcgacattgatatcaaaatctgttccaattatagaatagttgaaggcatgaatgacacaggaggagctgggtatttgaagagcatgaaacatctcacgggggttgatattacatttgatggtggatgtgttaaccctgaagctgtgttggcaaccctagagccaccttcaaatatcaagagcttatctatagataattacgatggtacaacaattccagtatggggaagagcagagattaattgggcaatctccctctcacatcttgtcgacatttggttttgggattgtagtgatttgcaggagatgccagtgctgagtaaactgcctcatttgaaatcactggaactttttaagttttgtaagttagagtacatggagagtagaagcagcagcagtagcagtgacacagaagcagcaacaccagaattaccaacattcttcccttcccttgaaaaacttacactttggtatctggaaaagttgaagggtttggggaacaggagatcgagtagttttccccgcctctctgaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatctgggttatctcaaatcactgcccacaaattgtctgactcacctcgacattacaataagagattccaaggagggggagggtgaatgggaagttggggaggcatttcagaagtgtgtatcttctttgagaaagctcagcataatcggaaatcacggaataaataaagtgaagagactgtctggaagaacagggttggagcatttcactctgttggactcactcaaattttcagatatagacgaccaggaagatgagggcgaagacaacatcatattctggaaatcctttcctcaaaaccttcgcagtttgagaattgaagactctgacaaaatgacaagtttgcccatggggatgcagtacttaacctccctccaaaccctctatctatcatattgtgatgaattgaattcccttccagaatggataagcagcttatcatctcttcaatccctgttcatatacaattgtccagccctgaaatcactaccagaagcaatgaagaacctcacctcccttcagagacttgagatacatcattgtccagacctagctgaaagatgcagaaaacccaacggggaggactatcccaaaattcaacacatccccggcattgaactatggcggtaa

SEQ ID NO: 63 - protein, 1150 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRGRGNERETRSYIDVKNILGRDKDKNDIIDRLLNRNDNEACSFLTIVGAGGLGKTALAQLVFNDERVKIEFHDLRYWVCVSDQDGGQFDVKEILCKILEVVTKEKVDNSSALELVQSQFQEKLRGKKYFLVLDDVWNEDREKWFKLEELLMLGQGGSKVVVTARSEKTANVIGKRHFYTLECLSPDYSWSLFEMSAFQKGHEQENHDELVDIGKKIVEKCYNNPLAITVVGSLLYGEEISKWRSFEMSELAKIGNGDNKILSILKLSYYNLANSLKSCFSYCAVFPKDHEIKKEMLIELWMAQGYVVPLDGGQSIEDAAEEHFVILLRRCFFQDVVKDEYGDVDSVKIHDLMHDVAQEVGREEICIVNANTKNLGDKIRHVHGDVNRYAQRVSLCSHKIRSYIGGNCEKRWVDTLIDKWMCLRMLDLSRSDVKNLPNSIGKLLHLRYLNLSGNRKLEILPDAITKLHNLQTLLLEGCGSLKELPKDFCKLVKLRHLDLWGCDDLIGMPLGMDMLTSLRVLPYFVVGRKKQSVDDELKALKGLTEIKGDIDIKICSNYRIVEGMNDTGGAGYLKSMKHLTGVDITFDGGCVNPEAVLATLEPPSNIKSLSIDNYDGTTIPVWGRAEINWAISLSHLVDIWFWDCSDLQEMPVLSKLPHLKSLELFKFCKLEYMESRSSSSSSDTEAATPELPTFFPSLEKLTLWYLEKLKGLGNRRSSSFPRLSELEIWECPDLTWFPPCPSLKTLKLEKNNEALQIIVKITTTRGKEEKEEDKNAGVGNSQDDDNVKLRKVEIDNLGYLKSLPTNCLTHLDITIRDSKEGEGEWEVGEAFQKCVSSLRKLSIIGNHGINKVKRLSGRTGLEHFTLLDSLKFSDIDDQEDEGEDNIIFWKSFPQNLRSLRIEDSDKMTSLPMGMQYLTSLQTLYLSYCDELNSLPEWISSLSSLQSLFIYNCPALKSLPEAMKNLTSLQRLEIHHCPDLAERCRKPNGEDYPKIQHIPGIELWR

SEQ ID NO: 64 - DNA, 8389 bp, Spinacia oleracea
  unsure 5171..5230
  unsure 5553..5602
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgccgagtttatacctgtttgtagggaaagggggaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccgcacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgcttcagttattgtgcagtgtttcccaaggatcatgaaataaagaaggagatgttgattgatctttggatagcacaaggatacgttgtggcacttgatggaggtcaaagtatagaagatgctgccgaagaacattttgtaattttgttacggagatgtttctttcaagatgtaaagaaggatgaatatggtgatgttgattctgttaaaatccacgacttgatgcacgatgtcgcccaagaagtggggagggaggaaatatgtgtagtgaatgataatacaaagaacttgggtgataaaatccgtcatgtacatggtgatgtcaatagatatgcacaaagagtctctctgtgtagccatagccataagattcgttcgtatattggtggtgattgtgaaaaacgttgtgtggatacactaatagacaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttaaaagattgcagaagtttaaaggagttgccaaaagatttttgcaaattggtcaaactgagacacttggatttatggggttgtgatgatttgattggtatgccatttggaatggataagctaactagtcttagaatactaccaaacattgtggtgggtaggaaggaacaaagtgttgatgatgagctgaaagcccttaaaggcctcaccgagataaaaggcgacattgatatcaaaatctgtgaaaattatagaatagttgaaggcatgaatgacacaggaggagctgggtatttgaagagcatgaaacatctcagggagattggtattacatttgatggtggatgtgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggggtctggaaaagttgaagggtttggggaacaggagatcgagtagttttccccgcctctctgaattgaaaatcatggaatgcccagatctaacgtggtttcctccctgtccaagccttgaaaaacttacactttggcgtctggacaagttgaagggttttgggaaccggagatcgagtacttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcaaatcactgcccacaaattgtcttactcacctcgaccttacaataagtgattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatacctgcgcatatactactgtccagccctgaaatcactaccagaagcaatgcggaacctcacctcccttcagacacttgggatatcggattgtccagacctagttaaaagatgcagaaaacccaacggcaaggactatcccaaaattcaacacatcccctattggagtatagaacatcaggttataactagcttgtaactaacttgtaactacctagtataaatacagtagtttgtactattttacattcaattacacaattaataaaatgtagactctcactctctctctctaagccacgagctccaagctcgtcaatggcttcccttctctgttcttgctttcttctttcctcttcaattcacaaattcaacatggtatcagagcgggacgatccttgctcttcacttccgcacaaaattttcgttcaattcaacccatcaaattttttttttcccccaaattttctcgaattcggtcaaaattcgacgaattagggattcaatttaccctgatttcttctgattccattcaatgattgttcatttcgaatcttgaatcaaataattgttgattctggattccccaaattctagggttcttgaaggatttacaagaatctggcattgctgatagattcttgaagcaatttgcgtctccgtgttcctcggtggtcttgagtttgtttccgtattcgctgctctcatctttactggggattgtggtctgatttcttggcttcctctgtcgatgatgtgattggtaatacttaaaacccctctctctctttccgaaattattgatgctggttcgtcatttttttttttggaatcatctcagtttatcgccgcaatttgagttgttgttgggtaattgttgttgctgccgatgatgttttgtgaatttgagaattgttagaatgattcttgttcaatcaatttggttctcatactctaatggaagcctgttttggagcgacgaattatgcaattctgagatttcttttgatccttatttcttttcttcacttgaatttctggtgtttgtgagtaattcttggttaatgtttgatctgggtagttcttgggtttactgaagacgtttcttgaaggttttgacagaaaagctgaggtttaattccaaaattcttctgtccaattacatttttattgttgatggttcttatgtgagaactagactgagttttttttatgaaattgtttcgaccttcagatggattcgagagatttgagttcattttctttgatgaatgtgttagaaaaggttttggtgcagtgaccattttaaaccaaatagagttacataaatattgggattcttttctgggaatgtagttaggagttgaaatcttttggagctgctttaccataaaacccagcctcagagtctgttaaccagttaggaccgtgtaaacatgatcccaggctgcatttgcgttatcagatttgattcagttttggaattgtggattttgagggtttaaaagcttacagttgctcctggagaatggtgtgagcaatataggaattcagcactagtattgcagaaaatgaagcttggttgttgattgttggcatgttttgttgccattgttttgggttgatgttttccttttcttttgaatgttggcacgattcaacatttctttcctgcaacagatttggagttcagtacctgtataatcaggtcaattttgttcatttttcccagcaacagatctggagaatcagaacctgtaaaannnnnnnnnnnnnnnnnnnnnnnnnnnnnnnnnnnnnnnnnnnnnnnnnnnnnnnnnnnnacccaaagaggtcagttttcattgatccattgtgatcattcttttgatgagacccattgaggctcatttcttcaaggcaatattggaagttgtagattgatatgagcagttggtacaacagcaacaaaagtggccagcatctatgcttgttcatgaggagttcttggtgcagagttaatgaagagtctgttttgaagctttcaaactgaagatgtttatcaccatctccagtttgagggggggtattggagtatagaacatcaggttataactagcttgtaactaacttgtaactacctagtataaatacagtagtttgtacnnnnnnnnnnnnnnnnnnnnnnnnnnnnnnnnnnnnnnnnnnnnnnnnnnccacgagctccaagctcgtcaatggcttcccttctctgttcttgctttcttctttcctcttcaattcacaaattcaacatccccaaaattgtaagtcattgcagaaagtaatttattcatttatatttattttatgcttagaatgatatacgcagtcgtcctttggtttcaaatcttgaatttggtttttgttttctttctttgtttctttattcaacaccagcccatttatgattgattcattaaaaaaaggatggagttttatggatttgaagaagacaacgaattgagattcctggggttttctttttgttggggttggatttcatgtatatgttgctgattaaatacgagactgatgatgatgatgtgtttatgggttttaaatcagattaaatatatgggaaatgcaagttaatttgggatgcacataaggtgtttgctgaaatgtctatgagaaatgttgtttcttggacttagaatgatatacactgtcgtcctttggtttccaatcttacatttggtttgtgttttcttagtttgtttctttaatcaacaccaacccgttttttttaaactacctgcaactactaatttacgtttaccctgtatctcaggtactaaatgaatattggtgattttcagttactcaacactagcttgatcctgaacgcacccaaccttcaggttagaatccggcttactcatccttttgtccagttttcaagtaattgttttggcaggatcaattctctaattgttgtacaccgtatattgcaatttatagtgactacagttaatgaatgtttacaaaaaattagtcatgtaaaaacttcttctctgtccattacataaactctttttctctttctaacttatcatgttcatgtctaaacaattaaacatgctcacatcaatgttcatttaagctaacttacttctgtaagagagcgagctagttaaaaactcctttaactttctgttttatactcaggacatggattgatgcaagcatgaagaacttcgggaatttgctaaaactctaccaaagcgatgagagtttggactttatttcacttgaagtcagggactgtcaacaaagccacagtgtgcatgttggctgtttcacttggacgataaaaaggtttatttaattgttttcctaagtgtatttggcttacaagcttttacttttcacttgaaagggtttttcttgttttaagcttttcgaattagagttttcggttgaagtaagagtagtcgtattagtcttttacctaaggaagactcttttttgtaattttcagactatgcaattcaagttttcgagtgttttcttgcttgtgtgattgtgagttggtgaattcgtctttcatacattttgagattatcagaagctttatgctccaccggtagtctagtaccttttctgttactgtgcagggaagtaatctggtaccttctatatatatggaaaaacatacattatacattatgcaaaattcttacaggttagttacttcctggaacttcatttacacttagttttttttgttccattccctcggaatcaagtcattccctctgagaaatatgtaatgaacttctgtatgttgctgtttggttcctgttttaatcttcaattttcttgtatagttacagctgcatttacaatgaagtttaagcagacactctctttatatagtgcctctttctggagcaccgtagagctgtctgtggttgatcaccatctgctgccgagagattcagcaatcgcgtgtttgatcaggtaaaagtttttatgtcaatgtgtttttttttccgtttgatcaatttatgtctgtattcagattcttatcttcttacagtagcataacacattgtttctttcatttatgtaaactgtttcaagattacagagatgtatgcttcagtcgacattgatgataacttaagatggcattcctacaacagttgcaggcgcattctaactccggcaattctagttaggcaagaggagcattgccaatacctgccacctctgggatttactataccagggttgaagtttatggaagacaccagctatgcacaagccttcaaggggtcatcctacataacaagttgaaccaaccaattgcttgttggttcagtggtaattgaagctgaatttggtagggatggcccgtgttcgatccccacaacaacaattgggaggggactggaacctatccacacagaactcgccctgaatccggattagccctaagggtgaacggggtgctaacaccaaaaaaaaaaacataacaagttgaaccaaacatactttgtttgaattgaagatttagtgatttcatttgatcgattgagatgtcttattataagcgtatatgctcttggatttggccacttaggtgttgtttgacaattggacattaactcgcttttatattttcttttctcttaggaaaggtgatcctgagaatttatattggaacactttttttttctcactagctttaaaaaagtgttctgtgttacctgcaattcaatttgattatttttcacatagttttacctgaaaaagtgttacctgaaaaagtgttacctgaaaatcaactgacataagtttttgtttggatccaattaaggacactagataaatcggaataaataatcaaccaattaagtacttcataattaaatatgaagtgtattattatcttatgcttgtgacattgaaggatgttatgatattttaactcaataccttgcaaaatatactgg

SEQ ID NO: 65 - DNA, 2000 bp, Spinacia oleracea; identical to SEQ ID NO: 13

SEQ ID NO: 66 - DNA, 3606 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgccgagtttatacctgtttgtagggaaagggggaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccgcacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgcttcagttattgtgcagtgtttcccaaggatcatgaaataaagaaggagatgttgattgatctttggatagcacaaggatacgttgtggcacttgatggaggtcaaagtatagaagatgctgccgaagaacattttgtaattttgttacggagatgtttctttcaagatgtaaagaaggatgaatatggtgatgttgattctgttaaaatccacgacttgatgcacgatgtcgcccaagaagtggggagggaggaaatatgtgtagtgaatgataatacaaagaacttgggtgataaaatccgtcatgtacatggtgatgtcaatagatatgcacaaagagtctctctgtgtagccatagccataagattcgttcgtatattggtggtgattgtgaaaaacgttgtgtggatacactaatagacaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttaaaagattgcagaagtttaaaggagttgccaaaagatttttgcaaattggtcaaactgagacacttggatttatggggttgtgatgatttgattggtatgccatttggaatggataagctaactagtcttagaatactaccaaacattgtggtgggtaggaaggaacaaagtgttgatgatgagctgaaagcccttaaaggcctcaccgagataaaaggcgacattgatatcaaaatctgtgaaaattatagaatagttgaaggcatgaatgacacaggaggagctgggtatttgaagagcatgaaacatctcagggagattggtattacatttgatggtggatgtgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggggtctggaaaagttgaagggtttggggaacaggagatcgagtagttttccccgcctctctgaattgaaaatcatggaatgcccagatctaacgtggtttcctccctgtccaagccttgaaaaacttacactttggcgtctggacaagttgaagggttttgggaaccggagatcgagtacttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcaaatcactgcccacaaattgtcttactcacctcgaccttacaataagtgattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatacctgcgcatatactactgtccagccctgaaatcactaccagaagcaatgcggaacctcacctcccttcagacacttgggatatcggattgtccagacctagttaaaagatgcagaaaacccaacggcaaggactatcccaaaattcaacacatcccctattggagtatagaacatcaggttataactagcttgtaa

SEQ ID NO: 67 - DNA, 3609 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgccgagtttatacctgtttgtagggaaagggggaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccgcacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgcttcagttattgtgcagtgtttcccaaggatcatgaaataaagaaggagatgttgattgatctttggatagcacaaggatacgttgtggcacttgatggaggtcaaagtatagaagatgctgccgaagaacattttgtaattttgttacggagatgtttctttcaagatgtaaagaaggatgaatatggtgatgttgattctgttaaaatccacgacttgatgcacgatgtcgcccaagaagtggggagggaggaaatatgtgtagtgaatgataatacaaagaacttgggtgataaaatccgtcatgtacatggtgatgtcaatagatatgcacaaagagtctctctgtgtagccatagccataagattcgttcgtatattggtggtgattgtgaaaaacgttgtgtggatacactaatagacaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttaaaagattgcagaagtttaaaggagttgccaaaagatttttgcaaattggtcaaactgagacacttggatttatggggttgtgatgatttgattggtatgccatttggaatggataagctaactagtcttagaatactaccaaacattgtggtgggtaggaaggaacaaagtgttgatgatgagctgaaagcccttaaaggcctcaccgagataaaaggcgacattgatatcaaaatctgtgaaaattatagaatagttgaaggcatgaatgacacaggaggagctgggtatttgaagagcatgaaacatctcagggagattggtattacatttgatggtggatgtgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggggtctggaaaagttgaagggtttggggaacaggagatcgagtagttttccccgcctctctgaattgaaaatcatggaatgcccagatctaacgtggtttcctccctgtccaagccttgaaaaacttacactttggcgtctggacaagttgaagggttttgggaaccggagatcgagtacttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcaaatcactgcccacaaattgtcttactcacctcgaccttacaataagtgattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatacctgcgcatatactactgtccagccctgaaatcactaccagaagcaatgcggaacctcacctcccttcagacacttgggatatcggattgtccagacctagttaaaagatgcagaaaacccaacggcaaggactatcccaaaattcaacacatcccctattggagtatagaacatcaggtactaaatgaatattggtga

SEQ ID NO: 68 - DNA, 3642 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgccgagtttatacctgtttgtagggaaagggggaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccgcacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgcttcagttattgtgcagtgtttcccaaggatcatgaaataaagaaggagatgttgattgatctttggatagcacaaggatacgttgtggcacttgatggaggtcaaagtatagaagatgctgccgaagaacattttgtaattttgttacggagatgtttctttcaagatgtaaagaaggatgaatatggtgatgttgattctgttaaaatccacgacttgatgcacgatgtcgcccaagaagtggggagggaggaaatatgtgtagtgaatgataatacaaagaacttgggtgataaaatccgtcatgtacatggtgatgtcaatagatatgcacaaagagtctctctgtgtagccatagccataagattcgttcgtatattggtggtgattgtgaaaaacgttgtgtggatacactaatagacaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttaaaagattgcagaagtttaaaggagttgccaaaagatttttgcaaattggtcaaactgagacacttggatttatggggttgtgatgatttgattggtatgccatttggaatggataagctaactagtcttagaatactaccaaacattgtggtgggtaggaaggaacaaagtgttgatgatgagctgaaagcccttaaaggcctcaccgagataaaaggcgacattgatatcaaaatctgtgaaaattatagaatagttgaaggcatgaatgacacaggaggagctgggtatttgaagagcatgaaacatctcagggagattggtattacatttgatggtggatgtgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggggtctggaaaagttgaagggtttggggaacaggagatcgagtagttttccccgcctctctgaattgaaaatcatggaatgcccagatctaacgtggtttcctccctgtccaagccttgaaaaacttacactttggcgtctggacaagttgaagggttttgggaaccggagatcgagtacttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcaaatcactgcccacaaattgtcttactcacctcgaccttacaataagtgattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatacctgcgcatatactactgtccagccctgaaatcactaccagaagcaatgcggaacctcacctcccttcagacacttgggatatcggattgtccagacctagttaaaagatgcagaaaacccaacggcaaggactatcccaaaattcaacacatcccctattggagtatagaacatcagttactcaacactagcttgatcctgaacgcacccaaccttcaggacatggattga

SEQ ID NO: 69 - protein, 1201 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRERGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTARSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIDLWIAQGYVVALDGGQSIEDAAEEHFVILLRRCFFQDVKKDEYGDVDSVKIHDLMHDVAQEVGREEICVVNDNTKNLGDKIRHVHGDVNRYAQRVSLCSHSHKIRSYIGGDCEKRCVDTLIDKWMCLRMLDLSWSDVKNLPNSIGKLLHLRYLNLSDNRNLKILPDAITRLHNLQTLLLKDCRSLKELPKDFCKLVKLRHLDLWGCDDLIGMPFGMDKLTSLRILPNIVVGRKEQSVDDELKALKGLTEIKGDIDIKICENYRIVEGMNDTGGAGYLKSMKHLREIGITFDGGCVNPEAVLATLEPPSNIKSLSIHRFDGKTLPVWGRAEINWAISLSHLVDIQLWHCRNLQEMPVLSKLPHLKSLELYNLISLEYMESTSRSSSSDTEAATPELPTFFPSLEKLTLWGLEKLKGLGNRRSSSFPRLSELKIMECPDLTWFPPCPSLEKLTLWRLDKLKGFGNRRSSTFPRLSELEIKKCPDLTSFPSCPSLEKLELKESNEALQIIVKITTRGKEKEENNNAGVRNSQDDDKVKLRKMVIDNLGYLKSLPTNCLTHLDLTISDSKEGEGEWEVGDAFQKCVSSLRSLTIIGNHGINKVKRLSGRTGLEHFTLLESLKLSDIEDQEDEGEDNIIFWKSFPQNLRSLRIKDSDKMTSLPMGMQYLTSLQTLYLHHCYELNSLPEWISSLSSLQYLRIYYCPALKSLPEAMRNLTSLQTLGISDCPDLVKRCRKPNGKDYPKIQHIPYWSIEHQVITSL

SEQ ID NO: 70 - protein, 1202 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRERGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTARSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIDLWIAQGYVVALDGGQSIEDAAEEHFVILLRRCFFQDVKKDEYGDVDSVKIHDLMHDVAQEVGREEICVVNDNTKNLGDKIRHVHGDVNRYAQRVSLCSHSHKIRSYIGGDCEKRCVDTLIDKWMCLRMLDLSWSDVKNLPNSIGKLLHLRYLNLSDNRNLKILPDAITRLHNLQTLLLKDCRSLKELPKDFCKLVKLRHLDLWGCDDLIGMPFGMDKLTSLRILPNIVVGRKEQSVDDELKALKGLTEIKGDIDIKICENYRIVEGMNDTGGAGYLKSMKHLREIGITFDGGCVNPEAVLATLEPPSNIKSLSIHRFDGKTLPVWGRAEINWAISLSHLVDIQLWHCRNLQEMPVLSKLPHLKSLELYNLISLEYMESTSRSSSSDTEAATPELPTFFPSLEKLTLWGLEKLKGLGNRRSSSFPRLSELKIMECPDLTWFPPCPSLEKLTLWRLDKLKGFGNRRSSTFPRLSELEIKKCPDLTSFPSCPSLEKLELKESNEALQIIVKITTRGKEKEENNNAGVRNSQDDDKVKLRKMVIDNLGYLKSLPTNCLTHLDLTISDSKEGEGEWEVGDAFQKCVSSLRSLTIIGNHGINKVKRLSGRTGLEHFTLLESLKLSDIEDQEDEGEDNIIFWKSFPQNLRSLRIKDSDKMTSLPMGMQYLTSLQTLYLHHCYELNSLPEWISSLSSLQYLRIYYCPALKSLPEAMRNLTSLQTLGISDCPDLVKRCRKPNGKDYPKIQHIPYWSIEHQVLNEYW

SEQ ID NO: 71 - protein, 1213 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRERGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTARSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIDLWIAQGYVVALDGGQSIEDAAEEHFVILLRRCFFQDVKKDEYGDVDSVKIHDLMHDVAQEVGREEICVVNDNTKNLGDKIRHVHGDVNRYAQRVSLCSHSHKIRSYIGGDCEKRCVDTLIDKWMCLRMLDLSWSDVKNLPNSIGKLLHLRYLNLSDNRNLKILPDAITRLHNLQTLLLKDCRSLKELPKDFCKLVKLRHLDLWGCDDLIGMPFGMDKLTSLRILPNIVVGRKEQSVDDELKALKGLTEIKGDIDIKICENYRIVEGMNDTGGAGYLKSMKHLREIGITFDGGCVNPEAVLATLEPPSNIKSLSIHRFDGKTLPVWGRAEINWAISLSHLVDIQLWHCRNLQEMPVLSKLPHLKSLELYNLISLEYMESTSRSSSSDTEAATPELPTFFPSLEKLTLWGLEKLKGLGNRRSSSFPRLSELKIMECPDLTWFPPCPSLEKLTLWRLDKLKGFGNRRSSTFPRLSELEIKKCPDLTSFPSCPSLEKLELKESNEALQIIVKITTRGKEKEENNNAGVRNSQDDDKVKLRKMVIDNLGYLKSLPTNCLTHLDLTISDSKEGEGEWEVGDAFQKCVSSLRSLTIIGNHGINKVKRLSGRTGLEHFTLLESLKLSDIEDQEDEGEDNIIFWKSFPQNLRSLRIKDSDKMTSLPMGMQYLTSLQTLYLHHCYELNSLPEWISSLSSLQYLRIYYCPALKSLPEAMRNLTSLQTLGISDCPDLVKRCRKPNGKDYPKIQHIPYWSIEHQLLNTSLILNAPNLQDMD

SEQ ID NO: 72 - DNA, 5179 bp, Spinacia oleracea
atggccgaaatcggatactcggtttgtgcgaaactcatcgaagtgattggcagtgagctgatcaaagagatttgcgacacatggggttacaaatctcttcttgaggacctcaacaaaactgtattgacggtcaggaacgttctcattcaggccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaagggggaacgagagggaaacacgttcatatatagatgtcaagaatattcttgggagggataaagataagaatgatatcatagataggttgcttaatcgtaatgataatgaagcttgtagtttcctgaccatagtgggagcgggaggattgggaaaaactgctcttgcccaacttgtgttcaatgatgaaagggtcaaaattgagtttcatgatttgaggtattgggtttgtgtctctgatcaagatgggggccaatttgatgtgaaagaaatcctttgtaagattttagaggtggttactaaggagaaagttgataatagttccgcattggaattggtacaaagccaatttcaagagaagttaagaggaaagaagtacttccttgttcttgatgacgtatggaacgaggatcgtgagaagtggcttcgtttggaagagttgttaatgttgggtcaagggggaagcaaggttgtagtgaccacacgttctgagaaaacagcaaatgtcatagggaaaagacatttatatacactggaatgtttgtcaccagattattcatggagcttatttgaaatgtcggcttttcagaaagggcaggagcaggaaaaccatcacgaactagttcgtattgggaaaaagattgttgaaaaatgttataacaatccacttgtgataaccgtggttggaagtcttctttatggagaggagataagtaagtggcaatcatttgaaaggagtgagttggccaaaattggcaatggggataacaagattttgtcgatattgaagctcagttactacaatcttgcaaactctttgaagagttgttttagttattgtgcagtgtttcccaaggatcatgaaataaagaaggagatgttgattgaactttggatggcacaaggatatgttgtgccgttggatggaggtcaaagtatagaagatgctgccgaagaacattttgtaattttgttacgaaggtgtttctttcaagatgtaaagaaggatgaatatggtgatgtttatgctgttaaaatccacgacttgatgcacgatgtcgcccaagaagtggggagggaggaaatatgtgtagtgaatgataatacaaagaacttgggtgataaaatccgtcatgtacactgtgatgtcaatagatatgcacaaagagtctctctgtgtagccataagattcgttcgtatattggtggtaaatgtgaaaaacgttgggtggatacactaatagacaagtggatgtgtcttagggtgttggacttgtcaaggtcggatgttaaaaatttgcctaattcaataggtaaattgttgcacttgaggtgtcttaacctgtcttataataaagatctgttgatactccctgatgcaattacaagactgcataatttgcagacactgcttttaaaagattgcagaagtttaaaggagttgccaaaagatttttgcaaattggtcaaactgagacacttggatttaaggggttgtgatgatttgattggtatgccattgggaatggatatgctaactagtcttagagtactgccattctttgtggtgggtaggaaggaacaaagtgatgatgatgagctgaaagccctaaaaggcctcaccgagataaaaggcgacattgatatcaaaatctgttccaattatagaatagttgaaggcatgaatgacacaggaggagctgggtatttgaagagcatgaaacatctcacgggggttattattacatttgatgataatgaagatggatgtgttaaacctgaagctgtattggaaacccttgagccaccttcaaatatcaagaggttacttataggaaggtaccgtggtacaacaattccagtatggggaagagcagagattaattgggcaatctccctctcacatcttgtcgatatcacgcttatttattgttataatttgcaggagattccagtgctgagtaaactgcctcatttgaaattactggaactttataagttgattagcttagagtacatggagaatacaagcagaagcagtagcagtgacacagaagcagcaacactagaattaccaacattcttcccttcccttaaaaaacttacacttatcggtctgacaaagttgaagggtctggggaacaggagatcgagtagttttccccgcctctctaaattggtaatctgggaatgcccagatctaacgtggtttcctccttgtccaagccttgaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatctgggttatctcaaatcactgcccacaaattgtctgactcacctcgacattacaataagagattccgaaggggaggagggtgaatgggaagttggggatacatttcagaagtgtgtatcttctttgagaagcctcgtcataatcggaaatcagggaataaataaagtgaatagactgtctggaagaacagggttggagcatttcactctgttggactcactcaaattttcagatatagacgaccaggaagatgagggcgaagacaacatcatgttctggaaatcctttcctcaaaacctccgcaatttggaaattaaatactctgacaaaatgacaagtttgcccatggggatgcagtacttaacctccctccaaaccatccatctttattgttgtggtaaattgaattccattccagaatggataagcagcttatcatctcttcaatccctgtacataggagaatgtccagccctaaaatcactaccagaagcaatgcagaacctcacctcccttcagagccttaggattttgggttgtccagacctaattgaaagatgcaaaaaacccaacggagaggactatcccaaaattcaacacatccccaaaattgtaagtcattgcagaaagtaatttattcatttatatttattttatgcttagaatgatatacaccgtcgtcctttggtttcaaatcttgaatttggtttttgttttctttctttgtttctttattcaacaccagcccatttatgattgattgattcattaaaaaaaggatggagttttgtggatttgaagaagacaacgaattgagattcctggggttttctttttgttggggttggttttcatgtatatgttgctgattaaatacgagactgatgatgattatgtgtttatgggttttaaatcagattaaatatatggaaaatgtaagttagttggggatgcacataaggtgtttgatgaaatgtctattagaaatgttgtttcttggacttagaatgatatacactgtcgtcctttggtttccaatcttacatttggtttgtgttttcttagtttgtttctttaatcaacaccagcccattttttttaaactacctgcaactactaattttcatttaccctgtatctcaggaactatggcggtaattctcatttactcaacactaagcttgatcctgaacgcagccaaccttcaggttagaatctgccttactcatccttttgtcatgcattgttttaaggtgttttgcttgcttgtgtaatcataatttatagtatacgattcatcattcactatgtctagaggcaagatattggaattgtacgattccctgaagtttctttgtttttgttgataccaccatattgcagcttatagtgactaagttaatgaatgtttccaaaaaattagtcatataaattcttcttctctctctattacataaactctttttctctttctaacttatcatgttcatgcctaaaacttatacatgctcacatcattgttcgtttgagctgacttacttctgtaagagagctatctagttaacaactcttgtaactttttatttgctagtcagaacatggattggtgcaagcatgggaatttgccaacactctaccaaatcgattggagtttggacttagtttcaccagaagccatacccggccacttactggggactgtcaacaaagccgcattgtgatgtacttggatgtttcacgtgcctgaggtgcgagttacttggaagggaagcggtttatttaattgttttcctaagtagattttgcttagaagcttttacttttcacttgaaagggtttttcttgttttaagcttttcgaattagagtttcggttgcattaagagtagtcgtattagtctttttttacctaaggaagacttttttgtaattttcagacgatgcaattcaacttttcgagtgttttgtttgaattgaagaattagtgatttcatttgatcgattgagatgtcttattataagcgtatatgctcttggatttggccacttaggtcttgtttgacaattggttattaactcgcttttatattttcttttctcttaggaaaggtgatcctgagaatttatattggaacactttttttctctctcactagctttaaaaaagtgttctgtgttacctgcaattcaatttgattatttttcacatagttttacctgaaaaagtgttacctgaaaatcaactgacataaatttttgtttggatccaattaaggacactagataagtcggaaaaaataatcaaccaattaagtacttcataattaagtatattattatcttgt

SEQ ID NO: 73 - DNA, 1121 bp, Spinacia oleracea
atcagaaaaccaaccttctccagtttactgttgtctaaagccaaagagcatggaattttccagtaatcgcagaccccaaattctcttctccaatcgtccctgtcaatttcagcaattgaatcaatcgttgattttaggatttgccgccaaaaaaatgaaaaatccatgaattttagggttcaaatttgatccgtaattgggaaaattttcagcaattgatcttccaaatcattcatacttgtttccagactgcaaatgaaaggtgcgaactttatactgcattttgattttccattactgtaatttattaagatgaactgcaatttgcaattgttttattcgactactcatctttaaatcaaattgctaaattgctagctaattttcttatcatattgccaaaaatttgttgcttaaatgattccatttctctaattatttttgttttattggtagataaataattaaatatcagccccattaattgaatattcaaaggaaatgtatggtccaaaaatggcgtttaatagtcaatgccgtgttttatggggtggtggagtactatatgactgtgtgtggacttggagaagactagagagtattgattatcaaaatatggaccctgaaaatgaaaatgaaaatgatgtttttacactttaaaatcgtcaagaaacaacaatcctctttagcaatagtatttacacgcgttatttgcacggacttcaatgcaaatagtataaatttacagtcaaagttttcattctaaagcgtaaataactttcatgaatggaggacggtagtataagtataacgttatggcctaccattttcttatcatattcacataaatttgttgctaaaagttgttttacttggctaaaatacttttgttcttattggcagataaacatcagtccattattggccaacttgaacatatacctccaaacaataatcaataatgtcgattatgaagtttgtgaatgcaatttattatcactttcatttataaaatgactacttgattaacacatacaatattacctttctccaaacaccctttcaattctgcttaatcttgttttctcatcatctcttcatctttctgaaaacacaaccca

SEQ ID NO: 74 - DNA, 3462 bp, Spinacia oleracea
atggccgaaatcggatactcggtttgtgcgaaactcatcgaagtgattggcagtgagctgatcaaagagatttgcgacacatggggttacaaatctcttcttgaggacctcaacaaaactgtattgacggtcaggaacgttctcattcaggccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaagggggaacgagagggaaacacgttcatatatagatgtcaagaatattcttgggagggataaagataagaatgatatcatagataggttgcttaatcgtaatgataatgaagcttgtagtttcctgaccatagtgggagcgggaggattgggaaaaactgctcttgcccaacttgtgttcaatgatgaaagggtcaaaattgagtttcatgatttgaggtattgggtttgtgtctctgatcaagatgggggccaatttgatgtgaaagaaatcctttgtaagattttagaggtggttactaaggagaaagttgataatagttccgcattggaattggtacaaagccaatttcaagagaagttaagaggaaagaagtacttccttgttcttgatgacgtatggaacgaggatcgtgagaagtggcttcgtttggaagagttgttaatgttgggtcaagggggaagcaaggttgtagtgaccacacgttctgagaaaacagcaaatgtcatagggaaaagacatttatatacactggaatgtttgtcaccagattattcatggagcttatttgaaatgtcggcttttcagaaagggcaggagcaggaaaaccatcacgaactagttcgtattgggaaaaagattgttgaaaaatgttataacaatccacttgtgataaccgtggttggaagtcttctttatggagaggagataagtaagtggcaatcatttgaaaggagtgagttggccaaaattggcaatggggataacaagattttgtcgatattgaagctcagttactacaatcttgcaaactctttgaagagttgttttagttattgtgcagtgtttcccaaggatcatgaaataaagaaggagatgttgattgaactttggatggcacaaggatatgttgtgccgttggatggaggtcaaagtatagaagatgctgccgaagaacattttgtaattttgttacgaaggtgtttctttcaagatgtaaagaaggatgaatatggtgatgtttatgctgttaaaatccacgacttgatgcacgatgtcgcccaagaagtggggagggaggaaatatgtgtagtgaatgataatacaaagaacttgggtgataaaatccgtcatgtacactgtgatgtcaatagatatgcacaaagagtctctctgtgtagccataagattcgttcgtatattggtggtaaatgtgaaaaacgttgggtggatacactaatagacaagtggatgtgtcttagggtgttggacttgtcaaggtcggatgttaaaaatttgcctaattcaataggtaaattgttgcacttgaggtgtcttaacctgtcttataataaagatctgttgatactccctgatgcaattacaagactgcataatttgcagacactgcttttaaaagattgcagaagtttaaaggagttgccaaaagatttttgcaaattggtcaaactgagacacttggatttaaggggttgtgatgatttgattggtatgccattgggaatggatatgctaactagtcttagagtactgccattctttgtggtgggtaggaaggaacaaagtgatgatgatgagctgaaagccctaaaaggcctcaccgagataaaaggcgacattgatatcaaaatctgttccaattatagaatagttgaaggcatgaatgacacaggaggagctgggtatttgaagagcatgaaacatctcacgggggttattattacatttgatgataatgaagatggatgtgttaaacctgaagctgtattggaaacccttgagccaccttcaaatatcaagaggttacttataggaaggtaccgtggtacaacaattccagtatggggaagagcagagattaattgggcaatctccctctcacatcttgtcgatatcacgcttatttattgttataatttgcaggagattccagtgctgagtaaactgcctcatttgaaattactggaactttataagttgattagcttagagtacatggagaatacaagcagaagcagtagcagtgacacagaagcagcaacactagaattaccaacattcttcccttcccttaaaaaacttacacttatcggtctgacaaagttgaagggtctggggaacaggagatcgagtagttttccccgcctctctaaattggtaatctgggaatgcccagatctaacgtggtttcctccttgtccaagccttgaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatctgggttatctcaaatcactgcccacaaattgtctgactcacctcgacattacaataagagattccgaaggggaggagggtgaatgggaagttggggatacatttcagaagtgtgtatcttctttgagaagcctcgtcataatcggaaatcagggaataaataaagtgaatagactgtctggaagaacagggttggagcatttcactctgttggactcactcaaattttcagatatagacgaccaggaagatgagggcgaagacaacatcatgttctggaaatcctttcctcaaaacctccgcaatttggaaattaaatactctgacaaaatgacaagtttgcccatggggatgcagtacttaacctccctccaaaccatccatctttattgttgtggtaaattgaattccattccagaatggataagcagcttatcatctcttcaatccctgtacataggagaatgtccagccctaaaatcactaccagaagcaatgcagaacctcacctcccttcagagccttaggattttgggttgtccagacctaattgaaagatgcaaaaaacccaacggagaggactatcccaaaattcaacacatccccaaaattgaactatggcggtaa

SEQ ID NO: 75 - protein, 1153 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRGRGNERETRSYIDVKNILGRDKDKNDIIDRLLNRNDNEACSFLTIVGAGGLGKTALAQLVFNDERVKIEFHDLRYWVCVSDQDGGQFDVKEILCKILEVVTKEKVDNSSALELVQSQFQEKLRGKKYFLVLDDVWNEDREKWLRLEELLMLGQGGSKVVVTTRSEKTANVIGKRHLYTLECLSPDYSWSLFEMSAFQKGQEQENHHELVRIGKKIVEKCYNNPLVITVVGSLLYGEEISKWQSFERSELAKIGNGDNKILSILKLSYYNLANSLKSCFSYCAVFPKDHEIKKEMLIELWMAQGYVVPLDGGQSIEDAAEEHFVILLRRCFFQDVKKDEYGDVYAVKIHDLMHDVAQEVGREEICVVNDNTKNLGDKIRHVHCDVNRYAQRVSLCSHKIRSYIGGKCEKRWVDTLIDKWMCLRVLDLSRSDVKNLPNSIGKLLHLRCLNLSYNKDLLILPDAITRLHNLQTLLLKDCRSLKELPKDFCKLVKLRHLDLRGCDDLIGMPLGMDMLTSLRVLPFFVVGRKEQSDDDELKALKGLTEIKGDIDIKICSNYRIVEGMNDTGGAGYLKSMKHLTGVIITFDDNEDGCVKPEAVLETLEPPSNIKRLLIGRYRGTTIPVWGRAEINWAISLSHLVDITLIYCYNLQEIPVLSKLPHLKLLELYKLISLEYMENTSRSSSSDTEAATLELPTFFPSLKKLTLIGLTKLKGLGNRRSSSFPRLSKLVIWECPDLTWFPPCPSLETLKLEKNNEALQIIVKITTTRGKEEKEEDKNAGVGNSQDDDNVKLWKVEIDNLGYLKSLPTNCLTHLDITIRDSEGEEGEWEVGDTFQKCVSSLRSLVIIGNQGINKVNRLSGRTGLEHFTLLDSLKFSDIDDQEDEGEDNIMFWKSFPQNLRNLEIKYSDKMTSLPMGMQYLTSLQTIHLYCCGKLNSIPEWISSLSSLQSLYIGECPALKSLPEAMQNLTSLQSLRILGCPDLIERCKKPNGEDYPKIQHIPKIELWR

SEQ ID NO: 76 - DNA, 6853 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgccgagtttatacctgtttgtagggaaagggggaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccgcacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgcttcagttattgtgcagtgtttcccaaggatcatgaaataaagaaggagatgttgattgatctttggatagcacaaggatacgttgtggcacttgatggaggtcaaagtatagaagatgctgccgaagaacattttgtaattttgttacggagatgtttctttcaagatgtaaagaaggatgaatatggtgatgttgattctgttaaaatccacgacttgatgcacgatgtcgcccaagaagtggggagggaggaaatatgtgtagtgaatgataatacaaagaacttgggtgataaaatccgtcatgtacatggtgatgtcaatagatatgcacaaagagtctctctgtgtagccatagccataagattcgttcgtatattggtggtgattgtgaaaaacgttgtgtggatacactaatagacaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttagaagattgcagaagtttaaaggagttgccaaaagatttttgcaaattggtcaaactgaggcacttggaattacagggttgtcatgatttgattggtatgccatttggaatggataagctaactagtcttagaatactaccaaacattgtggtgggtaggaaggaacaaagtgatgatgagctgaaagccctaaaaggcctcaccgagataaaaggctccatttctatcagaatctattcaaagtatagaatagttgaaggcatgaatgacacaggaggagctgcttatttgaagagcatgaaacatctcagggagattgatattacatttttgggtgaatgtgttggccctgaagctgtattggaaaccttagagccaccttcaaatatcaagagcttatatatatataattacagtggtacaacaattccagtatggggaagagcagagattaattgggcaatctccctctcacatctcgtcgacatccagcttagttgttgtagtaatttgcaggagatgccagtgctgagtaaactgcctcatttgaaatcgctgaaacttggatggttggataacttagagtacatggagagtagcagtagcagtgacacagaagcagcaacaccagaattaccaacattcttcccttcccttgaaaaacttactttacagcatctggaaaagttgaagggttttgggaacaggagatcgagtagttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttagactttggtatctggaaaagttgaagggtttggggaacaggagaccgagtagttttccccgcctctctgaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcaaattttcaaagatagaagaccaggaagatgagggcgaagacaacatcatattctggaaatcctttcctcaaaaccttcgcagtttgagaattaaagactctgacaaaatgacaagtttgcccatggggatgcagtacttaacctccctccaaaccctcgaactatcatattgtgatgaattgaattcccttccagaatggataagcagcttatcatctcttcaatacctgcgcatatactactgtccagccctgaaatcactaccagaagcaatgcggaacctcacctcccttcagacacttgggatatcggattgtccagacctagttaaaagatgcagaaaacccaacggcaaggactatcccaaaattcaacacatccccaaaattgtaagtcattgcagaaagtaatttattcatttatatttattttatgcttagaatgatatacgcagtcgtcctttggtttcaaatcttgaatttggtttttgttttctttctttgtttctttattcaacaccagcccatttatgattgattcattaaaaaaaggatggagttttatggatttgaagaagacaacgaattgagattcctggggttttctttttgttggggttggatttcatgtatatgttgctgattaaatacgagactgatgatgatgatgtgtttatgggttttaaatcagattaaatatatgggaaatgcaagttaatttgggatgcacataaggtgtttgctgaaatgtctatgagaaatgttgtttcttggacttagaatgatatacactgtcgtcctttggtttccaatcttacatttggtttgtgttttcttagtttgtttctttaatcaacaccaacccgttttttttaaactacctgcaactactaatttacgtttaccctgtatctcaggtactaaatgaatattggtgattttcagttactcaacactagcttgatcctgaacgcacccaaccttcaggttagaatccggcttactcatccttttgtccagttttcaagtaattgttttggcaggatcaattctctaattgttgtacaccgtatattgcaatttatagtgactacagttaatgaatgtttacaaaaaattagtcatgtaaaaacttcttctctgtccattacataaactctttttctctttctaacttatcatgttcatgtctaaacaattaaacatgctcacatcaatgttcatttaagctaacttacttctgtaagagagcgagctagttaaaaactcctttaactttctgttttatactcaggacatggattgatgcaagcatgaagaacttcgggaatttgctaaaactctaccaaagcgatgagagtttggactttatttcacttgaagtcagggactgtcaacaaagccacagtgtgcatgttggctgtttcacttggacgataaaaaggtttatttaattgttttcctaagtgtatttggcttacaagcttttacttttcacttgaaagggtttttcttgttttaagcttttcgaattagagttttcggttgaagtaagagtagtcgtattagtcttttacctaaggaagactcttttttgtaattttcagactatgcaattcaagttttcgagtgttttcttgcttgtgtgattgtgagttggtgaattcgtctttcatacattttgagattatcagaagctttatgctccaccggtagtctagtaccttttctgttactgtgcagggaagtaatctggtaccttctatatatatggaaaaacatacattatacattatgcaaaattcttacaggttagttacttcctggaacttcatttacacttagttttttttgttccattccctcggaatcaagtcattccctctgagaaatatgtaatgaacttctgtatgttgctgtttggttcctgttttaatcttcaattttcttgtatagttacagctgcatttacaatgaagtttaagcagacactctctttatatagtgcctctttctggagcaccgtagagctgtctgtggttgatcaccatctgctgccgagagattcagcaatcgcgtgtttgatcaggtaaaagtttttatgtcaatgtgtttttttttccgtttgatcaatttatgtctgtattcagattcttatcttcttacagtagcataacacattgtttctttcatttatgtaaactgtttcaagattacagagatgtatgcttcagtcgacattgatgataacttaagatggcattcctacaacagttgcaggcgcattctaactccggcaattctagttaggcaagaggagcattgccaatacctgccacctctgggatttactataccagggttgaagtttatggaagacaccagctatgcacaagccttcaaggggtcatcctacataacaagttgaaccaaccaattgcttgttggttcagtggtaattgaagctgaatttggtagggatggcccgtgttcgatccccacaacaacaattgggaggggactggaacctatccacacagaactcgccctgaatccggattagccctaagggtgaacggggtgctaacaccaaaaaaaaaaacataacaagttgaaccaaacatactttgtttgaattgaagatttagtgatttcatttgatcgattgagatgtcttattataagcgtatatgctcttggatttggccacttaggtgttgtttgacaattggacattaactcgcttttatattttcttttctcttaggaaaggtgatcctgagaatttatattggaacactttttttttctcactagctttaaaaaagtgttctgtgttacctgcaattcaatttgattatttttcacatagttttacctgaaaaagtgttacctgaaaaagtgttacctgaaaatcaactgacataagtttttgtttggatccaattaaggacactagataaatcggaataaataatcaaccaattaagtacttcataattaaatatgaagtgtattattatcttatgcttgtgacattgaaggatgttatgatattttaactcaataccttgcaaaatatactggttaaatttcttaacaaggtaacttggcaaca

SEQ ID NO: 77 - DNA, 2000 bp, Spinacia oleracea; identical to SEQ ID NO: 13

SEQ ID NO: 78 - DNA, 4146 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgccgagtttatacctgtttgtagggaaagggggaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccgcacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgcttcagttattgtgcagtgtttcccaaggatcatgaaataaagaaggagatgttgattgatctttggatagcacaaggatacgttgtggcacttgatggaggtcaaagtatagaagatgctgccgaagaacattttgtaattttgttacggagatgtttctttcaagatgtaaagaaggatgaatatggtgatgttgattctgttaaaatccacgacttgatgcacgatgtcgcccaagaagtggggagggaggaaatatgtgtagtgaatgataatacaaagaacttgggtgataaaatccgtcatgtacatggtgatgtcaatagatatgcacaaagagtctctctgtgtagccatagccataagattcgttcgtatattggtggtgattgtgaaaaacgttgtgtggatacactaatagacaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttagaagattgcagaagtttaaaggagttgccaaaagatttttgcaaattggtcaaactgaggcacttggaattacagggttgtcatgatttgattggtatgccatttggaatggataagctaactagtcttagaatactaccaaacattgtggtgggtaggaaggaacaaagtgatgatgagctgaaagccctaaaaggcctcaccgagataaaaggctccatttctatcagaatctattcaaagtatagaatagttgaaggcatgaatgacacaggaggagctgcttatttgaagagcatgaaacatctcagggagattgatattacatttttgggtgaatgtgttggccctgaagctgtattggaaaccttagagccaccttcaaatatcaagagcttatatatatataattacagtggtacaacaattccagtatggggaagagcagagattaattgggcaatctccctctcacatctcgtcgacatccagcttagttgttgtagtaatttgcaggagatgccagtgctgagtaaactgcctcatttgaaatcgctgaaacttggatggttggataacttagagtacatggagagtagcagtagcagtgacacagaagcagcaacaccagaattaccaacattcttcccttcccttgaaaaacttactttacagcatctggaaaagttgaagggttttgggaacaggagatcgagtagttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttagactttggtatctggaaaagttgaagggtttggggaacaggagaccgagtagttttccccgcctctctgaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcaaattttcaaagatagaagaccaggaagatgagggcgaagacaacatcatattctggaaatcctttcctcaaaaccttcgcagtttgagaattaaagactctgacaaaatgacaagtttgcccatggggatgcagtacttaacctccctccaaaccctcgaactatcatattgtgatgaattgaattcccttccagaatggataagcagcttatcatctcttcaatacctgcgcatatactactgtccagccctgaaatcactaccagaagcaatgcggaacctcacctcccttcagacacttgggatatcggattgtccagacctagttaaaagatgcagaaaacccaacggcaaggactatcccaaaattcaacacatccccaaaattgtactaaatgaatattggtga

SEQ ID NO: 79 - DNA, 4179 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgccgagtttatacctgtttgtagggaaagggggaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccgcacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgcttcagttattgtgcagtgtttcccaaggatcatgaaataaagaaggagatgttgattgatctttggatagcacaaggatacgttgtggcacttgatggaggtcaaagtatagaagatgctgccgaagaacattttgtaattttgttacggagatgtttctttcaagatgtaaagaaggatgaatatggtgatgttgattctgttaaaatccacgacttgatgcacgatgtcgcccaagaagtggggagggaggaaatatgtgtagtgaatgataatacaaagaacttgggtgataaaatccgtcatgtacatggtgatgtcaatagatatgcacaaagagtctctctgtgtagccatagccataagattcgttcgtatattggtggtgattgtgaaaaacgttgtgtggatacactaatagacaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttagaagattgcagaagtttaaaggagttgccaaaagatttttgcaaattggtcaaactgaggcacttggaattacagggttgtcatgatttgattggtatgccatttggaatggataagctaactagtcttagaatactaccaaacattgtggtgggtaggaaggaacaaagtgatgatgagctgaaagccctaaaaggcctcaccgagataaaaggctccatttctatcagaatctattcaaagtatagaatagttgaaggcatgaatgacacaggaggagctgcttatttgaagagcatgaaacatctcagggagattgatattacatttttgggtgaatgtgttggccctgaagctgtattggaaaccttagagccaccttcaaatatcaagagcttatatatatataattacagtggtacaacaattccagtatggggaagagcagagattaattgggcaatctccctctcacatctcgtcgacatccagcttagttgttgtagtaatttgcaggagatgccagtgctgagtaaactgcctcatttgaaatcgctgaaacttggatggttggataacttagagtacatggagagtagcagtagcagtgacacagaagcagcaacaccagaattaccaacattcttcccttcccttgaaaaacttactttacagcatctggaaaagttgaagggttttgggaacaggagatcgagtagttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttagactttggtatctggaaaagttgaagggtttggggaacaggagaccgagtagttttccccgcctctctgaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcaaattttcaaagatagaagaccaggaagatgagggcgaagacaacatcatattctggaaatcctttcctcaaaaccttcgcagtttgagaattaaagactctgacaaaatgacaagtttgcccatggggatgcagtacttaacctccctccaaaccctcgaactatcatattgtgatgaattgaattcccttccagaatggataagcagcttatcatctcttcaatacctgcgcatatactactgtccagccctgaaatcactaccagaagcaatgcggaacctcacctcccttcagacacttgggatatcggattgtccagacctagttaaaagatgcagaaaacccaacggcaaggactatcccaaaattcaacacatccccaaaattttactcaacactagcttgatcctgaacgcacccaaccttcaggacatggattga

SEQ ID NO: 80 - protein, 1381 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRERGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTARSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIDLWIAQGYVVALDGGQSIEDAAEEHFVILLRRCFFQDVKKDEYGDVDSVKIHDLMHDVAQEVGREEICVVNDNTKNLGDKIRHVHGDVNRYAQRVSLCSHSHKIRSYIGGDCEKRCVDTLIDKWMCLRMLDLSWSDVKNLPNSIGKLLHLRYLNLSDNRNLKILPDAITRLHNLQTLLLEDCRSLKELPKDFCKLVKLRHLELQGCHDLIGMPFGMDKLTSLRILPNIVVGRKEQSDDELKALKGLTEIKGSISIRIYSKYRIVEGMNDTGGAAYLKSMKHLREIDITFLGECVGPEAVLETLEPPSNIKSLYIYNYSGTTIPVWGRAEINWAISLSHLVDIQLSCCSNLQEMPVLSKLPHLKSLKLGWLDNLEYMESSSSSDTEAATPELPTFFPSLEKLTLQHLEKLKGFGNRRSSSFPRLSELEIKKCPDLTSFPSCPSLEKLELKESNEALQIIVKITTRGKEKEENNNAGVRNSQDDDKVKLRKMVIDNLGYLTGVDIRFDDREGGFVNPEAVLATLEPPSNIKSLSIHRFDGKTLPVWGRAEINWAISLSHLVDIQLWHCRNLQEMPVLSKLPHLKSLELYNLISLEYMESTSRSSSSDTEAATPELPTFFPSLEKLRLWYLEKLKGLGNRRPSSFPRLSELEIWECPDLTWFPPCPSLKTLKLEKNNEALQIIVKITTTRGKEEKEEDKNAGVGNSQDDDNVKLRKVEIDNVSYLKSLPTNCLTHLKITGIDYREGEIESDSVEEEIELEVGEAFQKCASSLRSLIIIGNHGINKVMRLSGRTGLEHFTLLDSLKFSKIEDQEDEGEDNIIFWKSFPQNLRSLRIKDSDKMTSLPMGMQYLTSLQTLELSYCDELNSLPEWISSLSSLQYLRIYYCPALKSLPEAMRNLTSLQTLGISDCPDLVKRCRKPNGKDYPKIQHIPKIVLNEYW

SEQ ID NO: 81 - protein, 1392 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRERGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTARSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIDLWIAQGYVVALDGGQSIEDAAEEHFVILLRRCFFQDVKKDEYGDVDSVKIHDLMHDVAQEVGREEICVVNDNTKNLGDKIRHVHGDVNRYAQRVSLCSHSHKIRSYIGGDCEKRCVDTLIDKWMCLRMLDLSWSDVKNLPNSIGKLLHLRYLNLSDNRNLKILPDAITRLHNLQTLLLEDCRSLKELPKDFCKLVKLRHLELQGCHDLIGMPFGMDKLTSLRILPNIVVGRKEQSDDELKALKGLTEIKGSISIRIYSKYRIVEGMNDTGGAAYLKSMKHLREIDITFLGECVGPEAVLETLEPPSNIKSLYIYNYSGTTIPVWGRAEINWAISLSHLVDIQLSCCSNLQEMPVLSKLPHLKSLKLGWLDNLEYMESSSSSDTEAATPELPTFFPSLEKLTLQHLEKLKGFGNRRSSSFPRLSELEIKKCPDLTSFPSCPSLEKLELKESNEALQIIVKITTRGKEKEENNNAGVRNSQDDDKVKLRKMVIDNLGYLTGVDIRFDDREGGFVNPEAVLATLEPPSNIKSLSIHRFDGKTLPVWGRAEINWAISLSHLVDIQLWHCRNLQEMPVLSKLPHLKSLELYNLISLEYMESTSRSSSSDTEAATPELPTFFPSLEKLRLWYLEKLKGLGNRRPSSFPRLSELEIWECPDLTWFPPCPSLKTLKLEKNNEALQIIVKITTTRGKEEKEEDKNAGVGNSQDDDNVKLRKVEIDNVSYLKSLPTNCLTHLKITGIDYREGEIESDSVEEEIELEVGEAFQKCASSLRSLIIIGNHGINKVMRLSGRTGLEHFTLLDSLKFSKIEDQEDEGEDNIIFWKSFPQNLRSLRIKDSDKMTSLPMGMQYLTSLQTLELSYCDELNSLPEWISSLSSLQYLRIYYCPALKSLPEAMRNLTSLQTLGISDCPDLVKRCRKPNGKDYPKIQHIPKILLNTSLILNAPNLQDMD

SEQ ID NO: 82 - DNA, 6953 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgccgagtttatacctgtttgtagggaaagggggaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccgcacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgcttcagttattgtgcagtgtttcccaaggatcatgaaataaagaaggagatgttgattgatctttggatagcacaaggatacgttgtggcacttgatggaggtcaaagtatagaagatgctgccgaagaacattttgtaattttgttacggagatgtttctttcaagatgtaaagaaggatgaatatggtgatgttgattctgttaaaatccacgacttgatgcacgatgtcgcccaagaagtggggagggaggaaatatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcatggtcggatgttaaaaatttgcctaattcaataggtaaattgttgcacttgaggtgtcttaacctgtcttataataaagatctgttgatactccctgatgcaattacaagactgcataatttgcagacactgcttttaaaagagtgcagaagtttaaaggagttgccaaaagatttttgcaaattggtcaaactgaggcacttggatttaaggtgttctgatttgaaggagttgccaaaagatttttgcaaattggtcaaactgaggcacttggatttaaggtgttctgatttgaaggagttgccaaaagatttttgcaaattggtcaaactgaggcacttggatttatggggttgtgatgatttgattggtgtgccattgggaatggataggctaattagtcttagagtactgccattctttgtggtgggtaggaaggaacaaagtgatgatgatgagctgaaagccctaaaaggcctcaccgagataaaaggctccattcgtattagaatctattcaaagtatagaatagttgaaggcatgaatgacacaggaggagctgggtatttaaagagcatgaaacatctcacgggggttgatattacatttgatggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagctttggtgttgtagtaatttgcaggagatgccagtgctgagtaaactgcctcatttgaaatcactgtatctttttaagttttgtaagttagagtacatggagagtagaagcagcagcagtagcagtgacacagaagcagcaacaccagaattaccaacattcttcccttcccttgaaaaacttagactttggtatctggaaaagttgaagggtttggggaacaggagaccgagtagttttccccgcctctctgaattggaaatctgggaatgcccagatctaacgtggtttcctccctgtccaagccttgaaaaacttacactttggcgtctggacaagttgaagggtttggggaacaggagatcgagtagttttccccgcctctctaaattggtaatctggaaatgcccagatctaacgtggtttcctccctgtccaagccttgaaaaacttacactttggcgtctggacaagttgaagggtttggggaacaggagatcgagtagttttccccgcctctctgaattggaaatcaagaaatgcccagatctaacgtggtttcctccttgtccaagccttgaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattatggacggtggaaatagacaatctgggttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcaaactttcaaatatagaagaccaggaagatgagggcgaagacaacatcatattctggaaatcctttcctcaaaaccttcgcagtttgagaattaaagactctgacaaaatgacaagtttgcccatggggatgcagtacttaacctccctccaaaccctcgaactatcatattgtgatgaattgaattcccttccagaatggataagcagcttatcatctcttcaatacctgcgcatatacaactgtccagccctgaaatcactaccagaagcaatgcggaacctcacctcccttcagacacttgggatatcggattgtccagacctagttaaaatatgcagaaaacccaacggcgaggactatcccaaaattcaacacatccccggcattgtaagtgattgcagaaagtattttattcatttatatttattttatgcttagaatgatatacgccgtcgtccttaggtttccaatcttgaatttggtttttgttttctttctttgtttctttattcaacaccagcccatttatgattgattcattaaaaaaaggaagaagacaacgaattgagattcctggggtttttttttcgttggggttggttttcatgtatatgttgctgattaaatacgagactgatgatgattatgtgtttatgggttttaaatcagattaaatatatggaaaatgtaagttagttggggatgcacataaggtgtttgatgaaatgtcttttagaaatgttgtttcttggacttagaatgatatacactgtcgtcctttggtttccaatcttacatttggtttgtgttttcttagtttgtttctttaatcaacaccaacccattttttttaaactacctgcaactactaatttacgtttaccctttatctcaggtactaaatgaatattggtgattttcagttactcaacactagcttgatcctgaacgcacccaaccttcaggttagaatccggcttactcatccttttgtccagttttcaagtaattgttttggcaggatcaattctctaattgttgtacaccgtatattgcaatttatagtgactacagttaatgaatgtttacaaaaaattagtcatgtaaaaacttcttctctgtccattacataaactctttttctctttctaacttatcatgttcatgtctaaaaaattaaacatgctcacatcaatgttcatttaagctaacttacttctgtaagagagcgagctagttaaaaactcctttaactttctgttttatactcaggagtcaggaaggatatggattgatgcagctttcacaggccaagtaatataatgttctttatcaatcactcaatacctggagattgtttgaacacataattcacctctttttttccatctcaaattgcagccttttactgggatttgaatgacagcaaacatttgattgtcacgaggattgatctaactggtgaatgttgtgatcaccatattggtctttctcattcaaacaaacttgcataccgttcttttgaagtttgaagacaagcaggcgataatcaactcaggtcgaagctcatgtgcaggagagaatagaatatagaggagattatttttaaaagaaacgctcaaaggtattgtagcacctttcctatttgctactgcagtgatgtttttatttcttgtttgcagcgcttgtttctcatatttcaacctacttttagaaaaaaaaacatctccgaacataaccaaaaataaagttcccttatcagtgctttccctgctttcttctgaacaacatatacaattataaaccctttttctctcttacctttgttattcttccttgcttcattgagataacactctcctgtttttgttttgttgttagtcattacatggatatatcaaggacaacagttctgtagtccgtcaactgtggttaggaaggctaaactggagcacaataaccccatgtcaattgaatagtaaaggtgtgctatatcagtttcgtttggcttggcttgtttacctgaaaaatggctggttatttatccttgtctctttctatgacgtgcagtggcttgttaatgtgtctcggacaacaattcctcactttccaagttccatacacgctgatgtaactatcttctgcagtctgttctttcatttttgccacgtgctctaattataactttttgtactcaataatcaactccttgtcccggtatttgcagagactacttaaacaggtaaagtgacaatcctggcgaagttgtctgtttcttagctctgatcccatcattcaggtaagattaagtagttaagaagaaacatttatttttacctaatttgaatgaacttgtgtaactgcttgcttcctgcattaaataagaaatttctgctgcatatgtgacagttacatccacaaaaaagttggaggtttgttcagggattggaaatgaaggtacttcagaatttgtttatgaatgctccagacttcagagtctttaatggaaaattcgagtcactaaaaatacattattcctatcatcagagctttcaagttcctctatacaaggtcaactgagttcctctttgcctcttgtttaattgtatttacttgtaccttaattataatctgtatattgttttagttaagttctaaaacaggttactattcatcatttgtgcagcatattgctggaatcaagaatctagtgcttcttcttcctgacttcactgtcaaaatagcagttcccatgctggaaataagcgcgctagcaatgtaattgatgacatggatgttgctgcttctgagttttgatcataaaaagctgttatgtgtttcttgaatgtaatgtagaagaggagaaaactgaaaactcttggcaaaaacgtgaaattgcagtgcctcggggtgggagggatcacccggattcagttcagacgatacttttttcaacccggtttgttccggttttcagcttcaggttttccttgtacttttgggggacacagacaaggctacttcatgtttgagaaacctaattgaggctatcttgtagcaaatgcacaccacactctttctctcttctctccttttttcaccttccatttgtaaaaatcctcctttaaaggttaataaaaaaaaagctccaagtctcgtagggtggatgtaggtcacattgaccgaaccacggtaaactctttgtgttctttcttctctctttgtttctcatttttacggcaagtgtttatggttaaccatgcatcttagaatagcttaaggcattaacataataacatcaatgttctccaaagattcaccttacttgttgtacataatcacaatgttaagcctatgaaggtagaatgctctcatgatttggtttaaccaaaaaataaactctaaaataatacggagtaataaaaattggccataaactaattacaaagtttgatttttgt

SEQ ID NO: 83 - DNA, 2000 bp, Spinacia oleracea; identical to SEQ ID NO: 13

SEQ ID NO: 84 - DNA, 3900 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgccgagtttatacctgtttgtagggaaagggggaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccgcacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgcttcagttattgtgcagtgtttcccaaggatcatgaaataaagaaggagatgttgattgatctttggatagcacaaggatacgttgtggcacttgatggaggtcaaagtatagaagatgctgccgaagaacattttgtaattttgttacggagatgtttctttcaagatgtaaagaaggatgaatatggtgatgttgattctgttaaaatccacgacttgatgcacgatgtcgcccaagaagtggggagggaggaaatatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcatggtcggatgttaaaaatttgcctaattcaataggtaaattgttgcacttgaggtgtcttaacctgtcttataataaagatctgttgatactccctgatgcaattacaagactgcataatttgcagacactgcttttaaaagagtgcagaagtttaaaggagttgccaaaagatttttgcaaattggtcaaactgaggcacttggatttaaggtgttctgatttgaaggagttgccaaaagatttttgcaaattggtcaaactgaggcacttggatttaaggtgttctgatttgaaggagttgccaaaagatttttgcaaattggtcaaactgaggcacttggatttatggggttgtgatgatttgattggtgtgccattgggaatggataggctaattagtcttagagtactgccattctttgtggtgggtaggaaggaacaaagtgatgatgatgagctgaaagccctaaaaggcctcaccgagataaaaggctccattcgtattagaatctattcaaagtatagaatagttgaaggcatgaatgacacaggaggagctgggtatttaaagagcatgaaacatctcacgggggttgatattacatttgatggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagctttggtgttgtagtaatttgcaggagatgccagtgctgagtaaactgcctcatttgaaatcactgtatctttttaagttttgtaagttagagtacatggagagtagaagcagcagcagtagcagtgacacagaagcagcaacaccagaattaccaacattcttcccttcccttgaaaaacttagactttggtatctggaaaagttgaagggtttggggaacaggagaccgagtagttttccccgcctctctgaattggaaatctgggaatgcccagatctaacgtggtttcctccctgtccaagccttgaaaaacttacactttggcgtctggacaagttgaagggtttggggaacaggagatcgagtagttttccccgcctctctaaattggtaatctggaaatgcccagatctaacgtggtttcctccctgtccaagccttgaaaaacttacactttggcgtctggacaagttgaagggtttggggaacaggagatcgagtagttttccccgcctctctgaattggaaatcaagaaatgcccagatctaacgtggtttcctccttgtccaagccttgaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattatggacggtggaaatagacaatctgggttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcaaactttcaaatatagaagaccaggaagatgagggcgaagacaacatcatattctggaaatcctttcctcaaaaccttcgcagtttgagaattaaagactctgacaaaatgacaagtttgcccatggggatgcagtacttaacctccctccaaaccctcgaactatcatattgtgatgaattgaattcccttccagaatggataagcagcttatcatctcttcaatacctgcgcatatacaactgtccagccctgaaatcactaccagaagcaatgcggaacctcacctcccttcagacacttgggatatcggattgtccagacctagttaaaatatgcagaaaacccaacggcgaggactatcccaaaattcaacacatccccggcattgtactaaatgaatattggtga

SEQ ID NO: 85 - protein, 1299 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRERGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTARSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIDLWIAQGYVVALDGGQSIEDAAEEHFVILLRRCFFQDVKKDEYGDVDSVKIHDLMHDVAQEVGREEICVVNDNTKNLGDKIRHVHRDVIRYAQRVSLCSHSHKIRSYIGGNCEKRCVDTLIDKWMCLRMLDLSWSDVKNLPNSIGKLLHLRCLNLSYNKDLLILPDAITRLHNLQTLLLKECRSLKELPKDFCKLVKLRHLDLRCSDLKELPKDFCKLVKLRHLDLRCSDLKELPKDFCKLVKLRHLDLWGCDDLIGVPLGMDRLISLRVLPFFVVGRKEQSDDDELKALKGLTEIKGSIRIRIYSKYRIVEGMNDTGGAGYLKSMKHLTGVDITFDGGCVNPEAVLATLEPPSNIKRLEMWHYSGTTIPVWGRAEINWAISLSHLVDIQLWCCSNLQEMPVLSKLPHLKSLYLFKFCKLEYMESRSSSSSSDTEAATPELPTFFPSLEKLRLWYLEKLKGLGNRRPSSFPRLSELEIWECPDLTWFPPCPSLEKLTLWRLDKLKGLGNRRSSSFPRLSKLVIWKCPDLTWFPPCPSLEKLTLWRLDKLKGLGNRRSSSFPRLSELEIKKCPDLTWFPPCPSLETLKLEKNNEALQIIVKITTTRGKEEKEEDKNAGVGNSQDDDNVKLWTVEIDNLGYLKSLPTNCLTHLKITGIDYREGEIESDSVEEEIELEVGEAFQKCASSLRSLIIIGNHGINKVMRLSGRTGLEHFTLLDSLKLSNIEDQEDEGEDNIIFWKSFPQNLRSLRIKDSDKMTSLPMGMQYLTSLQTLELSYCDELNSLPEWISSLSSLQYLRIYNCPALKSLPEAMRNLTSLQTLGISDCPDLVKICRKPNGEDYPKIQHIPGIVLNEYW

SEQ ID NO: 86 - DNA, 5768 bp, Spinacia oleracea
atggctgaaatcggatactcggtttgttcaaaacttattgaagtgatgggcagtaagatcattaaagagatttgcgacatgtggggttacaattctcatcttgacgacctcaacaaatctgtcttgacgatcaaggatgtgctcttggatgctgaggcgaagcgggatctttcccgtgaacaacagagttacattgcagaacttaaggatgttgtttacgatgctgatgatttgttcgatgagttcctcactcttgctgagctcaaacagattgatggcaacaacaagggtggtggtaaattctccaaaaaggtacgtcgtttcttttcttctaataaggagaagatgggtcaagcttacaagatgtctcatatggttaaagaaattaagaagcagttgggtgaaattgttgataggtataccaaatttgggtttattgttgattataaacctattattaggagaagggaggaaacatgttcttattttgtaggtgccaaggagattgttgggagggataaggataaagatgttatcataggcatgttgctagatcatgataacgattgtagtttcttggctgttgtgggggttggaggggtgggaaaaactactcttgcccaacttgtgtataatgatgaaagagtcaaaagtgagttccaagatttgaggtattgggtttgtgtctctgatcaagatgggggacaatttgatgacaaaagaattctttgtaagattatagagttagttacgggccagattcctccgagtaacgagagcatggaatcggtgcgtaagaaatttcaagaggaattaggaggaaagaagtacttccttgttcttgatgatgtatggaacgaggatcgccagaagtggcttcatctagaaaatttcttgaaattgggtcaagggggaagcaagattgtggtaaccacacgttcagagaagacggcaaatgttatagggaaaagacaagactataaactagaatgtttgtcagcagaggattcatggcgcttatttgaaatgtcagcttttgacgaagggcatggccaggaaaactatgacgaattagtgacgattggcaagaagattgttgaaaaatgttataacaatccacttgctataacagtggtaggaagccttctttttggacaagagataaataagtggcggtcgtttgaaagcagtggattagcccaaattgccaatggtgataatcagattttcccgatattaaagctcagttaccacaatcttccacactccttgaagagctgctttagctattgtgcagtgtttcccaaagattatgaaataaagaaggagatgttgattgatctttggatagcacaaggatacattataccgttggatggaggtcaaagtatagaagatgctgccgaggaacattttgtaattttgttaagaagatgtttctttcaagatgtaaagaaggattctcttggtaatgttgattatgttaaaatccacgacttaatgcacgatgtcgctcaagaagtggggaaggaggaaatctgtgtagtgacttcaggtacaaagaagttggctgataaaatccgtcacgtgggttgtgttgtcgatagagatccagaaatagtctttttatgtagcaataagattcgttcgtatattagcggtcgctgcataaagaatccggtggattcacaaatagacaactggatgtgccttagggtgttggacttgtcagattcatgtgttaaagatttgtctgattcaataggtaagctgctgcacttaaggtatcttaacctctcttctaatataaagttggagataatccctgatgcaattacaagactgcataacttgcagacactacttttagaagattgcagaagtttaaaggagttgccaaaagatttttgcaaattggtcaaactgaggcacttggaattacagggttgtcatgatttgattggtatgccatttggaatggataagctaactagtcttagaatactaccaaacattgtggtgggtaggaaggaacaaagtgatgatgagctgaaagccctaaaaggcctcaccgagataaaaggctccatttctatcagaatctattcaaagtatagaatagttgaaggcatgaatgacacaggaggagctgcttatttgaagagcatgaaacatctcagggagattgatattacatttttgggtgaatgtgttggccctgaagctgtattggaaaccttagagccaccttcaaatatcaagagcttatatatatataattacagtggtacaacaattccagtatggggaagagcagagattaattgggcaatctccctctcacatctcgtcgacatccagcttagttgttgtagtaatttgcaggagatgccagtgctgagtaaactgcctcatttgaaatcgctgaaacttggatggttggataacttagagtacatggagagtagcagtagcagtgacacagaagcagcaacaccagaattaccaacattcttcccttcccttgaaaaacttactttacagcatctggaaaagttgaagggttttgggaacaggagatcgagtagttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcaaatcactgcccacaaattgtcttactcaccttgaaattgaggagtttattgaatcagattccgaggaagagattgaatcagaagtcggggaggaggaggttgaattggaagttgtggaggcatttcagaagtctgcatcttctctgcaaagcctcgaaatatacagaataaataaactgaatagactaactggaacaacaggattagtgcatttcagtgccttggacgaactcacattgaattttgtcgacgattttgaagtatcctttcctcaaagcctccgcagtttgaaaattgaatactcttataaaatgacaagtctgcccatggggatgcagtacttaacctccctccaaaccctcgaactaaaatgttgtgatgaattgaattcccttccagaatggataagcaacttatcatctcttcaatccctgtccatatcctactgtgaagccctgaaatcactaccagaagcaatgcagaacctcacctcccttcagagacttgtgataagagaatgtcgagacctagctgaaagatgcgaagaacccaatggggaagactatcacaaaattcaacacatccccaaaattgtaagtgattgcggaaagtgtttcttttatttatttttaattttatgcttagaatgatatacatcagcattcagcgtccattggtttccaatcttacatttggtttttgttttcttagtttgtttctttaatcaacaccagcccattttttttaaactacctgcaactattaattttcatttaccctgtatctcaggaaatatggtagtattctcatttactcaacactagcttgatcctgaacgcagccaaccttcaggttagaatccgccttactcatccttttgtcatgcattgttttaagttgttttgcttgcttgtgtaatcataattcatagtatacgattcatcattcactatgtctacaggcaagatattggaattgttcacgattccctgaagtttctttgtttttgttgataccaccatattgcagcttatagtgactaagttaatgaatgtttccaaaaaattagtcatataaattcttcttctctctccattacataaactctttttctctttctaactatcatgttcatgtctaaaacttatacatgctcacatcattgttcgtttcagctgacttacttctgtaagagagctatctagttaacaactcttgtaacattttatttgctagtcagaacatggattggtgcaagcatgggaatatgctaacactctaccaaatcgattggagtttggacttagtttcaccagaagccatacccggacacttactggggactgtcaacaaagccgcattgtgatgtacttggatgtttcacgtgcctgaggtgcgagttacttggaagggaagcggtttatttaattgttttcccaagtagattttgcttacaagcttttacttttcacttgaaagggtttttcttgttttaagcttttcgaattagagttttcggttgcattaagagtagtcgtattagtcttttacctaaggaagactcttttttgtaattttcagactatgcaattcaagttttcgagtgttttcttgcttgtgtgattgtgagttggtgaattcgtctttcatacattttgagattatcagaagctttatgctccaccggtagtctagtaccttttctgttactgtgcagggaagtaatctggtaccttctatatatatggaaaaacatacattatacattatgcaaaattcttacaggttagttacttcctggaacttcatttacacttagttttttttgttccattccctcggaatcaagtcattccctctgagaaatatgtaatgaacttctgtatgttgctgtttggttcctgttttaatcttcaattttcttgtatagttacagctgcatttacaatgaagtttaagcagacactctctttatatagtgcctctttctggagcaccgtagagctgtctgtggttgatcaccatctgctgccgagagattcagcaatcgcgtgtttgatcaggtaaaagtttttatgtcaatgtgtttttttttccgtttgatcaatttatgtctgtattcagattcttatcttcttacagtagcataacacattgtttctttcatttatgtaaactgtttcaagattacagagatgtatgcttcagtcgacattgatgataacttaagatggcattcctacaacagttgcaggcgcattctaactccggcaattctagttaggcaagaggagcattgccaatacctgccacctctgggatttactataccagggttgaagtttatggaagacaccagctatgcacaagccttcaaggggtcatcctacataacaagttgaaccaaccaattgcttgttggttcagtggtaattggagctgaatttggtagggatggcccgtgttcgatccccacaacaacaattgggaggggactggaacctatccacacagaactcgccctgaatccggattagccctaagggtgaacggggtgctaacaccaaaaaaaaaaacataacaagttgaaccaaacatactttgtttgaattgaagatttagtgatttcatttgatcgattgagatgtcttattataagcgtatatgctcttggatttggccacttaggtgttgtttgacaattggtcattaactcgcttttatattttcttttctcttaggaaaggtgatcctgagaatttatattggaacactttttttttctcactagctttaaaaaagtgttctgtgttacctgcaattcaatttgattatttttcacatagttttacctgaaaaagtgttacctgaaaaagtgttacctgaaaatcaactgacataagtttttgtttggatccaattaaggacactagataaatcg

SEQ ID NO: 87 - DNA, 2001 bp, Spinacia oleracea
  unsure 245
attaaaaaaattaaaaaaataaataaattacttattccttctatttttacttgttacacttttctacaacagaaacatcaaaacgcccgcaacacactataaatgaaaaaccattttgtatgcaatgatatttacgttctcactttattctctttaataactcctactacgtaattctcaccaatcaaataaaattatagaaattttcatttataccctcttaaaatgatgttgatttttttttnaggtgtgaaaaagtttgtgttataagttacaacaatttaaaaacggagaacatacttataatactagtgtaatctttggccggattatggtcgttgacaaaaaaactccggccttgaccctccacgtgccggtcaagtgacttaataaaccttttattccacccttttttcattcttctttttattcttctttttctctccattaatacaaatcaagtgattatgtcgatccgatccttctgttctctactgtaattgattacaccaacaacaaccaagcgaaacagtcaatgttaccgaattgaattgcggaaaatagtttatgattgattcattaaaaaaggatggagttttgtggatttgaataagacaacgaattgagattcctggggttttctttctgttggggttggatttcatgtacttgttgatgatcaaatatgtgattgaagatgatgatgtgtttatgggtttgaaatcggattaaatttatgggaaatgtaagtgaattggggatgcacataaggtgtttgatgaaatgtctatgagaaatattgtttcttgcacttgtatgataatttgtggggatttgattagttcatggtgcgagtttgatgcaatgccgaagagaaatcaggtctttagagaaactcaaatggttgaataggcttccaacaatgttgtttcgtagtacactgccatgattgatagagaaggaagcagatgaaggagaaggctcatgtgaccggcacatgggtagtaagtcaacgccggaaatcgtggtcaacgtccaaaaccgagctaaggtaacatattggagtacaagtaattacaacaaaaagtgttacttccttgtacattattattttacttgaaatgctagttgtgtttgtgcatctgtggaactctaaattaattaattaaccatcaaccaaacaactttagtgtaaattggccaaccttttgccatcagccacagaaaagtgaaatatcaccccattattgcccattctgtatttgcattttttttaaggcatagcacagccggttttccggatcttagctccgtctacattcggatccgatccatttcgcacaccttgtttgtggtggatgagtctcccaacaagaatttctcgctcgaaactgagaacccccttaagcggcatcaagttgcttaccacttgagccaactctatgttggtttctgcatttgcagttagttaggtcgtctgagtgcgaaatgggaatgctttatcacacactccacagtttagtcaggctgatggaaacgtaataattgagttatttgagtgttcaaacttaaagtcagtcactcactcaaacactcaatactttctccatcttgttttctcattacatatgaaaacccaaacacctttcatttctgcttaatcttctttctctcatctttcagttattcacctgttcatctttctgaaaacaacccaaacacccttcatttctgcttaatcttcttttctcatcttcatccacctgtttatctttctgtaaacacaacccaaacacctttcatttctgatttatcttgttatctcatcttcattcacctgttcatctttctgaaaatctaaacacccttcatttctgctgatcttcttttctaatctccccctaaatcatctttctgaaaacccaaacacctttcttttctgcttttatcttgttttctcatcttaattcatctcttcatctttctgaaaaacccaaccca

SEQ ID NO: 88 - DNA, 3434 bp, Spinacia oleracea
atggctgaaatcggatactcggtttgttcaaaacttattgaagtgatgggcagtaagatcattaaagagatttgcgacatgtggggttacaattctcatcttgacgacctcaacaaatctgtcttgacgatcaaggatgtgctcttggatgctgaggcgaagcgggatctttcccgtgaacaacagagttacattgcagaacttaaggatgttgtttacgatgctgatgatttgttcgatgagttcctcactcttgctgagctcaaacagattgatggcaacaacaagggtggtggtaaattctccaaaaaggtacgtcgtttcttttcttctaataaggagaagatgggtcaagcttacaagatgtctcatatggttaaagaaattaagaagcagttgggtgaaattgttgataggtataccaaatttgggtttattgttgattataaacctattattaggagaagggaggaaacatgttcttattttgtaggtgccaaggagattgttgggagggataaggataaagatgttatcataggcatgttgctagatcatgataacgattgtagtttcttggctgttgtgggggttggaggggtgggaaaaactactcttgcccaacttgtgtataatgatgaaagagtcaaaagtgagttccaagatttgaggtattgggtttgtgtctctgatcaagatgggggacaatttgatgacaaaagaattctttgtaagattatagagttagttacgggccagattcctccgagtaacgagagcatggaatcggtgcgtaagaaatttcaagaggaattaggaggaaagaagtacttccttgttcttgatgatgtatggaacgaggatcgccagaagtggcttcatctagaaaatttcttgaaattgggtcaagggggaagcaagattgtggtaaccacacgttcagagaagacggcaaatgttatagggaaaagacaagactataaactagaatgtttgtcagcagaggattcatggcgcttatttgaaatgtcagcttttgacgaagggcatggccaggaaaactatgacgaattagtgacgattggcaagaagattgttgaaaaatgttataacaatccacttgctataacagtggtaggaagccttctttttggacaagagataaataagtggcggtcgtttgaaagcagtggattagcccaaattgccaatggtgataatcagattttcccgatattaaagctcagttaccacaatcttccacactccttgaagagctgctttagctattgtgcagtgtttcccaaagattatgaaataaagaaggagatgttgattgatctttggatagcacaaggatacattataccgttggatggaggtcaaagtatagaagatgctgccgaggaacattttgtaattttgttaagaagatgtttctttcaagatgtaaagaaggattctcttggtaatgttgattatgttaaaatccacgacttaatgcacgatgtcgctcaagaagtggggaaggaggaaatctgtgtagtgacttcaggtacaaagaagttggctgataaaatccgtcacgtgggttgtgttgtcgatagagatccagaaatagtctttttatgtagcaataagattcgttcgtatattagcggtcgctgcataaagaatccggtggattcacaaatagacaactggatgtgccttagggtgttggacttgtcagattcatgtgttaaagatttgtctgattcaataggtaagctgctgcacttaaggtatcttaacctctcttctaatataaagttggagataatccctgatgcaattacaagactgcataacttgcagacactacttttagaagattgcagaagtttaaaggagttgccaaaagatttttgcaaattggtcaaactgaggcacttggaattacagggttgtcatgatttgattggtatgccatttggaatggataagctaactagtcttagaatactaccaaacattgtggtgggtaggaaggaacaaagtgatgatgagctgaaagccctaaaaggcctcaccgagataaaaggctccatttctatcagaatctattcaaagtatagaatagttgaaggcatgaatgacacaggaggagctgcttatttgaagagcatgaaacatctcagggagattgatattacatttttgggtgaatgtgttggccctgaagctgtattggaaaccttagagccaccttcaaatatcaagagcttatatatatataattacagtggtacaacaattccagtatggggaagagcagagattaattgggcaatctccctctcacatctcgtcgacatccagcttagttgttgtagtaatttgcaggagatgccagtgctgagtaaactgcctcatttgaaatcgctgaaacttggatggttggataacttagagtacatggagagtagcagtagcagtgacacagaagcagcaacaccagaattaccaacattcttcccttcccttgaaaaacttactttacagcatctggaaaagttgaagggttttgggaacaggagatcgagtagttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcaaatcactgcccacaaattgtcttactcaccttgaaattgaggagtttattgaatcagattccgaggaagagattgaatcagaagtcggggaggaggaggttgaattggaagttgtggaggcatttcagaagtctgcatcttctctgcaaagcctcgaaatatacagaataaataaactgaatagactaactggaacaacaggattagtgcatttcagtgccttggacgaactcacattgaattttgtcgacgattttgaagtatcctttcctcaaagcctccgcagtttgaaaattgaatactcttataaaatgacaagtctgcccatggggatgcagtacttaacctccctccaaaccctcgaactaaaatgttgtgatgaattgaattcccttccagaatggataagcaacttatcatctcttcaatccctgtccatatcctactgtgaagccctgaaatcactaccagaagcaatgcagaacctcacctcccttcagagacttgtgataagagaatgtcgagacctagctgaaagatgcgaagaacccaatggggaagactatcacaaaattcaacacatccccaaaattgaaatatggtagta

SEQ ID NO: 89 - protein, 1143 aa, Spinacia oleracea
MAEIGYSVCSKLIEVMGSKIIKEICDMWGYNSHLDDLNKSVLTIKDVLLDAEAKRDLSREQQSYIAELKDVVYDADDLFDEFLTLAELKQIDGNNKGGGKFSKKVRRFFSSNKEKMGQAYKMSHMVKEIKKQLGEIVDRYTKFGFIVDYKPIIRRREETCSYFVGAKEIVGRDKDKDVIIGMLLDHDNDCSFLAVVGVGGVGKTTLAQLVYNDERVKSEFQDLRYWVCVSDQDGGQFDDKRILCKIIELVTGQIPPSNESMESVRKKFQEELGGKKYFLVLDDVWNEDRQKWLHLENFLKLGQGGSKIVVTTRSEKTANVIGKRQDYKLECLSAEDSWRLFEMSAFDEGHGQENYDELVTIGKKIVEKCYNNPLAITVVGSLLFGQEINKWRSFESSGLAQIANGDNQIFPILKLSYHNLPHSLKSCFSYCAVFPKDYEIKKEMLIDLWIAQGYIIPLDGGQSIEDAAEEHFVILLRRCFFQDVKKDSLGNVDYVKIHDLMHDVAQEVGKEEICVVTSGTKKLADKIRHVGCVVDRDPEIVFLCSNKIRSYISGRCIKNPVDSQIDNWMCLRVLDLSDSCVKDLSDSIGKLLHLRYLNLSSNIKLEIIPDAITRLHNLQTLLLEDCRSLKELPKDFCKLVKLRHLELQGCHDLIGMPFGMDKLTSLRILPNIVVGRKEQSDDELKALKGLTEIKGSISIRIYSKYRIVEGMNDTGGAAYLKSMKHLREIDITFLGECVGPEAVLETLEPPSNIKSLYIYNYSGTTIPVWGRAEINWAISLSHLVDIQLSCCSNLQEMPVLSKLPHLKSLKLGWLDNLEYMESSSSSDTEAATPELPTFFPSLEKLTLQHLEKLKGFGNRRSSSFPRLSELEIKKCPDLTSFPSCPSLEKLELKESNEALQIIVKITTRGKEKEENNNAGVRNSQDDDKVKLRKMVIDNLGYLKSLPTNCLTHLEIEEFIESDSEEEIESEVGEEEVELEVVEAFQKSASSLQSLEIYRINKLNRLTGTTGLVHFSALDELTLNFVDDFEVSFPQSLRSLKIEYSYKMTSLPMGMQYLTSLQTLELKCCDELNSLPEWISNLSSLQSLSISYCEALKSLPEAMQNLTSLQRLVIRECRDLAERCEEPNGEDYHKIQHIPKIEIW

SEQ ID NO: 90 - DNA, 8415 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgccgagtttatacctgtttgtagggaaagggggaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccgcacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgcttcagttattgtgcagtgtttcccaaggatcatgaaataaagaaggagatgttgattgatctttggatagcacaaggatacgttgtggcacttgatggaggtcaaagtatagaagatgctgccgaagaacattttgtaattttgttacggagatgtttctttcaagatgtaaagaaggatgaatatggtgatgttgattctgttaaaatccacgacttgatgcacgatgtcgcccaagaagtggggagggaggaaatatgtgtagtgaatgataatacaaagaacttgggtgataaaatccgtcatgtacatggtgatgtcaatagatatgcacaaagagtctctctgtgtagccatagccataagattcgttcgtatattggtggtgattgtgaaaaacgttgtgtggatacactaatagacaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttagaagattgcagaagtttaaaggagttgccaaaagatttttgcaaattggtcaaactgagacacttggatttatggggttgtgatgatttgattggtatgccatttggaatggataagctaactagtcttagaatactaccaaacattgtggtgggtaggaaggaacaaagtgttgatgatgagctgaaagcccttaaaggcctcaccgagataaaaggcgacattgatatcaaaatctgtgaaaattatagaatagttgaaggcatgaatgacacaggaggagctgggtatttgaagagcatgaaacatctcagggagattggtattacatttgatggtggatgtgttaaccctgaagctgtgttggcaaccctagagccaccttcaaatatcaagagcttatctatagataattacgatggtacaacaattccagtatggggaagagcagagattaattgggcaatctccctctcacatcttgtcgacatcacgcttgaagattgttacaatttgcaggagatgccagtgctgagtaaactgcctcatttgaaatcactgtatctttttaagttttgtaagttagagtacatggagagtagaagcagcagcagtagcagtgacacagaagcagcaacaccagaattaccaacattcttcccttcccttgaaaaacttagactttggtatctggaaaagttgaagggtttggggaacaggagaccgagtagttttccccgcctctctgaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcaaattttcaaagatagaagaccaggaagatgagggcgaagacaacatcatattctggaaatcctttcctcaaaacctccgcagtttggaaattaaaggctcttgcaaaatgacaagtttgcccatggggatgcagtacttaacctccctccaaaccctcgaactatcatattgtgatgaattgaattcccttccagaatggataagcagcttatcatctcttcaatacctgcgcatatacaactgtccagccctgaaatcactaccagaagcaatgcggaacctcacctcccttcagacacttgggatatcggattgtccagacctagttaaaatatgcagaaaacccaacggcgaggactatcccaaaattcaacacatccccggcattgtaagtgattgcagaaagtattttattcatttatatttattttatgcttagaatgatatacgccgtcgtccttaggtttccaatcttgaatttggtttttgttttctttctttgtttctttattcaacaccagcccatttatgattgattcattaaaaaaaggaagaagacaacgaattgagattcctggggtttttttttcgttggggttggttttcatgtatatgttgctgattaaatacgagactgatgatgattatgtgtttatgggttttaaatcagattaaatatatggaaaatgtaagttagttggggatgcacataaggtgtttgatgaaatgtctattagaaatgttgtttcttggacttagaatgatatacactgtcgtcctttggtttccaatcttacatttggtttgtgttttcttagtttgtttctttaatcaacaccaacccattttttttaaactacctgcaactactaatttacgtttaccctttatctcaggtactaaatgaatattggtgattttcagttactcaacactagcttgatcctgaacgcacccaaccttcaggttagaatccggcttactcatccttttgtccagttttcaagtaattgttttggcaggatcaattctctaattgttgtacaccgtatattgcaatttatagtgactacagttaatgaatgtttacaaaaaattagtcatgtaaaaacttcttctctgtccattacataaactcattttctctttctaacttatcatgttcatgtttaaaaaattaaacatgctcacatcattgttcatttgagctaacttacttctgtaagagagcgagctagttaacaactcctttaactttctgttttatactcaggacatggattgatgcaagcatgaagaacttctggaatttgctaaaactctaccaaagcgatgagagtttggactttgtttcacttgaagtcagggattgtcaacaaagccacagtgtgcatgttggctgtgtcacttggacgataaaaaggtttatttaattgttttcctaagtgtatttggcttacaagcttttacttttcacttgaaagggttttttttgttttaagctttttgaattagagtttcggttgaagtaagagtagtcgtattagtcttttactttgcaggagtctatgcctatataaggtaagactcgtatttgtaattttcagattatgcaattcaagttttcgagtgttttcttaaaaaaacatatcatacctgtgtgtagcataaagataaattctgatgctgtgcttcttgttatggctcacattggttttcattgtttggattgtttcacagggaagcagagaatacctggaacctatgaaggacgctatatctatagcagctttcacaggccaagtaatataatgttctttatcaatcactcaatacctggagattgtttgaacacataattcacctctttttttccatctcaaattgcagacttttactgggatttgaatgacagcaaacatttgattgtcacgaggattgatctaactggtgaatgttgtgatcaccatattggtctttctcattcaaacaaacttgcataccgttcttttgaattttgaagacaagcaggcgataatcaactcaggtcgaagctcatgtgcaggagagaatcgaatatagaggagattatttttaaaagaaacgctcaaaggtattgtagcacctttcctatttgctactgcagtgatgtttttatttcttgtttgcagcgcttgtttctcatatttcaacctacttttagaaaaaaaaacatctccgaacataaccaaaaataaagttcccttatcagtgctttccctgctttcttctaaacaacatatacaattataaaccctttttctctcttacctttgttattcttccttgcttcattgagataacactctcctgtttttgttttgttgttagtcattacatggatatatcaaggacaacagttctgtagtccgtcaactgtggttaggaaggctaaactggagcacaataaccccatgtcaattgaatagtaaaggtgtgctatatcagtttcgtttggcttggcttgtttacctgaaaaatggctggttatttatccttgtctctttctatgacgtgcagtggcttgttaatgtgtctcggacaacaattcctcactttccaagttccatacacgctgatgtaactatcttctgcagtctgttctttcatttttgccacgtgctctaattataactttttgtactcaataatcaactccttgtcccggtatttgcagagactacttaaacaggtaaagtgacaatcctggcgaagttgtctgtttcttagctctgaacccatcattcaggtaagattaagtatttaagaagaaattttgtttttacctaaaatgaatgatcttgtgtaactgcttgcttcttgcattaaataagaactttctgctgcatatgtgacagttacatccacaaaaaagttggaggtttgttcagggattggaaatgaaggtacttcagaattcctggaatgtttatgaatgctccagacttcagagtctttaatggaaaattcgagtcactaaaaatacattattcctatcatcagagctttcaagttcctctatacaaggtcaactgagttcctctttgcctcttgtttaattgtatttacttgtaccttaactataatctgtatattgttttagttaagttctaaaacaggttactattcatcatttgtgcagcatattgctggaatcaagaatctagtgcttcttcttcctgacttcactgtaaaccttaatctgttgctgaatttttttaatcgaaagactttctgtttaattatattctaaatctattacgatgtcttaaacagcttgaaaatgacacaaaatataatagctccacacctagataagaccctcaaatggaaatgtcagtaacttgttacatagagacaatatgctgatatatagttccacatagatcactcttctttactaaaaacacattatttttataacctggacattagtcgagagggggatgtcacgtcatgagaaatcttcatcagagccttcattactcggaattttattttctcccaaagctggtgaatttgccatagatgttgctgtacttcattcttatgatgttcaggtgacttgtcaggcctcactgcctcagactaacactctcgtgtttcttttctgttgttagtcatgacatggatacatcacgaacaacagttctgtagtccagcaactgtggtgtaggaagactaaactggagcacaataactccatgtcaattgaatggtaaagatgtgctatctcagtttcttttggcttgtttacatgaaaaacggctcgttttttatctgtgtctttctatgacgttcaggtgcagtggcttgttaatgtgtctcagacaacaattttctcactttccaagttccatacatgctgatgtaactatcttctgcactctgttctttcattttgccttttgctctaattataactttttgtactcaataatcaactccttgtcgcgtatttgcagggattacttaaataggtatagtgacaatcctggtgaagttgtctgtttcttagctctgatcccatcattcaggtaagattaagtagttaagaagaaacatttatttttacctaatttgaatgaacttgtgttaactgcttgcttcctgcattaaataagaactttctgctgcatatgtgacagttacatccacaaaaaagttggaggtttgttcagggattggaaatgaaggtacttcagaattcctggaatgtttatgaatgctccagacttcagagtctttaatggaaaattcgagtcactaaaaatacattattcctatcatcagagctttcaagttcctctatacaaggtcaactgagttcctctttgcctcttgtttaattgtatttactcgtaccttaattataatctgtatattgttttagttaagttctaaaacaggttactattcatcatttgtgcagcatattgctggaatcaagaatctagtgcttcatcttcctgacttcactgtcaaaatagtagttcccatgctggaaataagcgcgctagcaatgtaattgatgacatggatgttgctgcttctgagttttgatcataaaaagctgttatgtgtttcttgaatgtaatgaaggagaggagaaaactgaaaactcttggcaaaaacgtgaaattgcagtgcctcggggtggtagggatcacccggattcagttcagacgatacttttttcaacccggtttgttccggttttcagcttcgggttttccttgtacttttggggcacacatacaaggctacttcatgtttgagaaacctaattgaggctatcttgtagcaaatgcacaccacactctttctctcttctctccttttttcaccttccatttgtaaaaatcctcttttaaaggttaataaaaaaaagcttcaagtctcgtagggtggatgtaggtcacattgaccgaaccacggtaaactctttgtgttctttcttctctctttgtttctcatttttacggcaagtgtttatggttaaccatgcatcttagaatagcttaaggcattaacataataacatcaatgttctccaaagattcaccttacttgttgtacataatcacaatgttaagcctatgaaggtagaatgctctcatgatttggtttaaccaaaaaataaactctaaaataatacggagtaataaaaattggccataaactaattacaaagtttgatttttgtatagggtatcttgtacttgtgataaaaaaaattaaaaaaaaaaaatttacttatttcttctatttttacttgttacacttttctaca

SEQ ID NO: 91 - DNA, 2000 bp, Spinacia oleracea
ggcttaacttgctcaccaattcttaaatagactcgacttacactgaatttattgtgtactatgtctagaaagtaaggtcaacaactttcttctaaattattttggcatgtttattagggttattatgaaaaacatatcaaattggtgttgttagttaggcttgaataatatgattttaagtcacgagacttttataaattaggtaatttgatttaaaaaattgttacatatctaagaaaatggatgttaaatttatcagtcaatgtataaacaataaaagtcaatatgtatgtaaaagggttgctagataaaatctttggttttttggtccacaactccacactaagaggaactccaatgcttagttacaaggtggtgtagttaaaaagtaactccaatagttaactacacggtattatagttaaatttgccaactcaaatttctaactacaatatatttaagctacaaagtttctcattggctgactacaatacgttgtagcgccttataatattttattcaatatacaattttatttattttacctttttaacaatttttttttgatctacctgctgtcctgttcatatgagctacactaatttgatagctgcttacgcaattcttatatcaacggttggctacttgttcaaatatttttatttttttacgagtaagtcattttatgatcattgaagtggctctattattattatcatgcaccgattaacgcaagaataattaactcggtacgaattagtttcaaaataaaatccctcaaaaaaaaaagtttcaaaataaaattaacagaaaaccaaccttctccggtttactgttgttagagcatggaattttccagtaatcgcagaccccaaattatcttccagttgaatcaatccttgatttttggatttgccagaaaactccttgaattttagggttcatatttgatccgtaattgggaaaattttcagcaattgatcttccaaatcagccctacttgtttccagactgcaaatgaaaggtgcgaactttatactgcattttggttttccattagtgtaatttagtgtaatttattaagataaactgcattttgcaattgttttattcgactactcatttttaaatcaaattgcttaattgctagttagttttcttatcatattgccaaaaaaaattatttttgtttaattggtgaaaaagggtaaattatacctagtgtacaagattttcttgcacaccaccgttaatttgttgacacatcatcaaacgtactgaaaaatgagaatgaaagacaataaatatgtcattttaaccaatagaaaaacatgatgtagtaagatccttaattgatagataaataattaaatatcagtccattagttgaatattcaatgaaaatgtatggtccaaaaatggcgtttaatagtcaatgtcatgctttatggggtggtggagtactatgtgactgtgtgtggacttggagaagactagagagtatgattatcaacctatggaccctcaaaatgaaaatgaaaatgatgtttacacgtgctatttgcacggacttcaatgcaaatagtataaatttacggtcaaagttttcattctaaagcgtaaataactttcatgaatggaggacggtagtataagtataacgttatagcctaccattttcttatcatattcacataaatttgttgctgaaatttgttttacttggctaaaatacttttgttcttattggcagataaacatcagtacgtccattattggccaacttgctgagtccattattggccaacttgaacatatacctccaaacaataatcaataatgtcgattatgaagtttgtgaatgcaatttattatcactttcatttataaaatgactacttgattaacacatacaatattacctttctccaaacaccctttcaattctgcttaatcttgttttctcatcatctcttcatctttctgaaaacacaaccca

SEQ ID NO: 92 - DNA, 3492 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgccgagtttatacctgtttgtagggaaagggggaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccgcacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgcttcagttattgtgcagtgtttcccaaggatcatgaaataaagaaggagatgttgattgatctttggatagcacaaggatacgttgtggcacttgatggaggtcaaagtatagaagatgctgccgaagaacattttgtaattttgttacggagatgtttctttcaagatgtaaagaaggatgaatatggtgatgttgattctgttaaaatccacgacttgatgcacgatgtcgcccaagaagtggggagggaggaaatatgtgtagtgaatgataatacaaagaacttgggtgataaaatccgtcatgtacatggtgatgtcaatagatatgcacaaagagtctctctgtgtagccatagccataagattcgttcgtatattggtggtgattgtgaaaaacgttgtgtggatacactaatagacaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttagaagattgcagaagtttaaaggagttgccaaaagatttttgcaaattggtcaaactgagacacttggatttatggggttgtgatgatttgattggtatgccatttggaatggataagctaactagtcttagaatactaccaaacattgtggtgggtaggaaggaacaaagtgttgatgatgagctgaaagcccttaaaggcctcaccgagataaaaggcgacattgatatcaaaatctgtgaaaattatagaatagttgaaggcatgaatgacacaggaggagctgggtatttgaagagcatgaaacatctcagggagattggtattacatttgatggtggatgtgttaaccctgaagctgtgttggcaaccctagagccaccttcaaatatcaagagcttatctatagataattacgatggtacaacaattccagtatggggaagagcagagattaattgggcaatctccctctcacatcttgtcgacatcacgcttgaagattgttacaatttgcaggagatgccagtgctgagtaaactgcctcatttgaaatcactgtatctttttaagttttgtaagttagagtacatggagagtagaagcagcagcagtagcagtgacacagaagcagcaacaccagaattaccaacattcttcccttcccttgaaaaacttagactttggtatctggaaaagttgaagggtttggggaacaggagaccgagtagttttccccgcctctctgaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcaaattttcaaagatagaagaccaggaagatgagggcgaagacaacatcatattctggaaatcctttcctcaaaacctccgcagtttggaaattaaaggctcttgcaaaatgacaagtttgcccatggggatgcagtacttaacctccctccaaaccctcgaactatcatattgtgatgaattgaattcccttccagaatggataagcagcttatcatctcttcaatacctgcgcatatacaactgtccagccctgaaatcactaccagaagcaatgcggaacctcacctcccttcagacacttgggatatcggattgtccagacctagttaaaatatgcagaaaacccaacggcgaggactatcccaaaattcaacacatccccggcattgtactaaatgaatattggtga

SEQ ID NO: 93 - DNA, 3525 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgccgagtttatacctgtttgtagggaaagggggaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaagatcgtgagaagtggcttcctttggaagagttgttaatgttgggtcaagggggaagcaaggttgtagtgaccgcacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgcttcagttattgtgcagtgtttcccaaggatcatgaaataaagaaggagatgttgattgatctttggatagcacaaggatacgttgtggcacttgatggaggtcaaagtatagaagatgctgccgaagaacattttgtaattttgttacggagatgtttctttcaagatgtaaagaaggatgaatatggtgatgttgattctgttaaaatccacgacttgatgcacgatgtcgcccaagaagtggggagggaggaaatatgtgtagtgaatgataatacaaagaacttgggtgataaaatccgtcatgtacatggtgatgtcaatagatatgcacaaagagtctctctgtgtagccatagccataagattcgttcgtatattggtggtgattgtgaaaaacgttgtgtggatacactaatagacaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttagaagattgcagaagtttaaaggagttgccaaaagatttttgcaaattggtcaaactgagacacttggatttatggggttgtgatgatttgattggtatgccatttggaatggataagctaactagtcttagaatactaccaaacattgtggtgggtaggaaggaacaaagtgttgatgatgagctgaaagcccttaaaggcctcaccgagataaaaggcgacattgatatcaaaatctgtgaaaattatagaatagttgaaggcatgaatgacacaggaggagctgggtatttgaagagcatgaaacatctcagggagattggtattacatttgatggtggatgtgttaaccctgaagctgtgttggcaaccctagagccaccttcaaatatcaagagcttatctatagataattacgatggtacaacaattccagtatggggaagagcagagattaattgggcaatctccctctcacatcttgtcgacatcacgcttgaagattgttacaatttgcaggagatgccagtgctgagtaaactgcctcatttgaaatcactgtatctttttaagttttgtaagttagagtacatggagagtagaagcagcagcagtagcagtgacacagaagcagcaacaccagaattaccaacattcttcccttcccttgaaaaacttagactttggtatctggaaaagttgaagggtttggggaacaggagaccgagtagttttccccgcctctctgaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcaaattttcaaagatagaagaccaggaagatgagggcgaagacaacatcatattctggaaatcctttcctcaaaacctccgcagtttggaaattaaaggctcttgcaaaatgacaagtttgcccatggggatgcagtacttaacctccctccaaaccctcgaactatcatattgtgatgaattgaattcccttccagaatggataagcagcttatcatctcttcaatacctgcgcatatacaactgtccagccctgaaatcactaccagaagcaatgcggaacctcacctcccttcagacacttgggatatcggattgtccagacctagttaaaatatgcagaaaacccaacggcgaggactatcccaaaattcaacacatccccggcattttactcaacactagcttgatcctgaacgcacccaaccttcaggacatggattga

SEQ ID NO: 94 - protein, 1163 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRERGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTARSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIDLWIAQGYVVALDGGQSIEDAAEEHFVILLRRCFFQDVKKDEYGDVDSVKIHDLMHDVAQEVGREEICVVNDNTKNLGDKIRHVHGDVNRYAQRVSLCSHSHKIRSYIGGDCEKRCVDTLIDKWMCLRMLDLSWSDVKNLPNSIGKLLHLRYLNLSDNRNLKILPDAITRLHNLQTLLLEDCRSLKELPKDFCKLVKLRHLDLWGCDDLIGMPFGMDKLTSLRILPNIVVGRKEQSVDDELKALKGLTEIKGDIDIKICENYRIVEGMNDTGGAGYLKSMKHLREIGITFDGGCVNPEAVLATLEPPSNIKSLSIDNYDGTTIPVWGRAEINWAISLSHLVDITLEDCYNLQEMPVLSKLPHLKSLYLFKFCKLEYMESRSSSSSSDTEAATPELPTFFPSLEKLRLWYLEKLKGLGNRRPSSFPRLSELEIWECPDLTWFPPCPSLKTLKLEKNNEALQIIVKITTTRGKEEKEEDKNAGVGNSQDDDNVKLRKVEIDNVSYLKSLPTNCLTHLKITGIDYREGEIESDSVEEEIELEVGEAFQKCASSLRSLIIIGNHGINKVMRLSGRTGLEHFTLLDSLKFSKIEDQEDEGEDNIIFWKSFPQNLRSLEIKGSCKMTSLPMGMQYLTSLQTLELSYCDELNSLPEWISSLSSLQYLRIYNCPALKSLPEAMRNLTSLQTLGISDCPDLVKICRKPNGEDYPKIQHIPGIVLNEYW

SEQ ID NO: 95 - protein, 1174 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRERGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTARSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIDLWIAQGYVVALDGGQSIEDAAEEHFVILLRRCFFQDVKKDEYGDVDSVKIHDLMHDVAQEVGREEICVVNDNTKNLGDKIRHVHGDVNRYAQRVSLCSHSHKIRSYIGGDCEKRCVDTLIDKWMCLRMLDLSWSDVKNLPNSIGKLLHLRYLNLSDNRNLKILPDAITRLHNLQTLLLEDCRSLKELPKDFCKLVKLRHLDLWGCDDLIGMPFGMDKLTSLRILPNIVVGRKEQSVDDELKALKGLTEIKGDIDIKICENYRIVEGMNDTGGAGYLKSMKHLREIGITFDGGCVNPEAVLATLEPPSNIKSLSIDNYDGTTIPVWGRAEINWAISLSHLVDITLEDCYNLQEMPVLSKLPHLKSLYLFKFCKLEYMESRSSSSSSDTEAATPELPTFFPSLEKLRLWYLEKLKGLGNRRPSSFPRLSELEIWECPDLTWFPPCPSLKTLKLEKNNEALQIIVKITTTRGKEEKEEDKNAGVGNSQDDDNVKLRKVEIDNVSYLKSLPTNCLTHLKITGIDYREGEIESDSVEEEIELEVGEAFQKCASSLRSLIIIGNHGINKVMRLSGRTGLEHFTLLDSLKFSKIEDQEDEGEDNIIFWKSFPQNLRSLEIKGSCKMTSLPMGMQYLTSLQTLELSYCDELNSLPEWISSLSSLQYLRIYNCPALKSLPEAMRNLTSLQTLGISDCPDLVKICRKPNGEDYPKIQHIPGILLNTSLILNAPNLQDMD

SEQ ID NO: 96 - DNA, 4949 bp, Spinacia oleracea
atggctgaaatcggatactcggtttgttcaaaacttattgaagtgatgggcagtaagatcattaaagagatttgcgacatgtggggttacaattctcatcttgacgacctcaacaaatctgtcttgacgatcaaggatgtgctcttggatgctgaggcgaagcgggatctttcccgtgaacaacagagttacattgcagaacttaaggatgttgtttacgatgctgatgatttgttcgatgagttcctcactcttgctgagctcaaacagattgatggcaacaacaagggtggtggtaaattctccaaaaaggtacgtcgtttcttttcttctaataaggagaagatgggtcaagcttacaagatgtctcatatggttaaagaaattaagaagcagttgggtgaaattgttgataggtataccaaatttgggtttattgttgattataaacctattattaggagaagggaggaaacatgttcttattttgtaggtgccaaggagattgttgggagggataaggataaagatgttatcataggcatgttgctagatcatgataacgattgtagtttcttggctgttgtgggggttggaggggtgggaaaaactactcttgcccaacttgtgtataatgatgaaagagtcaaaagtgagttccaagatttgaggtattgggtttgtgtctctgatcaagatgggggacaatttgatgacaaaagaattctttgtaagattatagagttagttacgggccagattcctccgagtaacgagagcatggaatcggtgcgtaagaaatttcaagaggaattaggaggaaagaagtacttccttgttcttgatgatgtatggaacgaggatcgccagaagtggcttcatctagaaaatttcttgaaattgggtcaagggggaagcaagattgtggtaaccacacgttcagagaagacggcaaatgttatagggaaaagacaagactataaactagaatgtttgtcagcagaggattcatggcgcttatttgaaatgtcagcttttgacgaagggcatggccaggaaaactatgacgaattagtgacgattggcaagaagattgttgaaaaatgttataacaatccacttgctataacagtggtaggaagccttctttttggacaagagataaataagtggcggtcgtttgaaagcagtggattagcccaaattgccaatggtgataatcagattttcccgatattaaagctcagttaccacaatcttccacactccttgaagagctgctttagctattgtgcagtgtttcccaaagattatgaaataaagaaggagatgttgattgatctttggatagcacaaggatacattataccgttggatggaggtcaaagtatagaagatgctgccgaggaacattttgtaattttgttaagaagatgtttctttcaagatgtaaagaaggattctcttggtaatgttgattatgttaaaatccacgacttaatgcacgatgtcgctcaagaagtggggaaggaggaaatctgtgtagtgacttcaggtacaaagaagttggctgataaaatccgtcacgtgggttgtgttgtcgatagagatccagaaatagtctttttatgtagcaataagattcgttcgtatattagcggtcgttgtataaagaatccggtggattcacaaatagacaactggatgcgccttagggtgttggacttgtcagattcatgtgttaaagatttgtctgattcaataggtaagctgctgcacttaaggtatcttaacctctcttctaatataaagttggagataatccctgatgcaattacaagactgcataacttgcagacactgcttttaaaagattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaacttacagagttggataacttagagtacatggagagtagaagcagcagcagtagcagtgacacagaagcagcaacaccagaattaccaacattcttcccttcccttgaaaaacttacactttggggtctggaaaagttgaagggtttggggaacaggagatcgagtagttttccccgcctctctaaattggaaatctgggaatgcccagatctaacgtcatttccttcttgtccaagccttgaaaagttggaattgaaagaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatctgggttatctcaaatcactgcccacaaattgtctgactcacctcgaccttacaataagtgattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatacctgcgcatatactactgtccagccctgaaatcactaccagaagcaatgcggaacctcacctcccttcagacacttgggatatcggattgtccagacctagttaaaagatgcagaaaacccaacggcaaggactatcccaaaattcaacacatccccaaaattgtaagtcattgcagaaagtaatttattcatttatatttattttatgcttagaatgatatacaccgtcgtcctttggtttcaaatcttgaatttggtttttgttttctttctttgtttctttattcaacaccagcccatttatgattgattcattaaaaaaaggatggagttttgtggatttgcagaagacaacgaattgagattcgtggggttttctttttgttggggttggatttcatgtatatgttgctgattgaatacgagactgatgatgatgatgtgtttaatttatgggttttaaatcagattaaatatatgggaaatgtaagttaattggggatgcacataaggtgtttgatgaaatgtctattagaaatgttgtttcttggacttagaatgatatacactgtcgtcctttggtttccaatctggaatttggtttttgttttcttagtttgtttctttattccacactagcccattttttttaaactacctgcaactactaaatttcatttaccctgtatctcagattagagggtagtaattctcatttactcaacactagcttgatcctgaacgcagccaaccttcaggttagaatccgccttactcatccttttgtcatgtattgttttaagttgttttgcttgcttgtgtaatcatgattcatagtatacgattcatcattcactatgtctacaggcaagatattggaattgttcacgattccctgaagtttctttgcttttgttgataccaccatattgcagcttatagtgactaagttaatgaatgtttcaaaaaaattagtcatataaattcttcttctctctctattacataaactctttttctctttctaacttatcatgttcatgtctaaaacttatacatgctcacatcattgttcgtttcagctgacttacttctgtaagagagctatctagttaacaactcttgtaacattttatttgctagtcagaacatggattggtgcaagcatgggaatttgccaacactctaccaaatcgattggagtttggacttagtttcaccagaagccatacccggccacttactggggactgtcaacaaagccgcattgtgatgtacttggatgtttcacgtgcctgaggtgtgagttacttggaagggaagcggtttatttaattgttttcctaagtagattttgcttagaagcttttacttttcacttgaaagggtttttcttgttttaagcttttcgaattagagtttcggttgcattaagagtagtcgtattagtctttttttacctaaggaagacttttttgtaattttcagacgatgcaattcaacttttcgagtgttttgtttgaattgaagaattagtgatttcatttgatcgattgagatgtcttattataagcgtatatgctcttggatttggccacttaggtcttgtttgacaattggttattaactcgcttttatattttcttttctcttaggaaagg

SEQ ID NO: 97 - DNA, 2000 bp, Spinacia oleracea
  unsure 857..876
gagcaagtgcaccagcaggaaagatttaccaggagtatggaattacagttgaggcagttgttgaagctgcaaaatcagtttgttaggattctttttgcctcctgtttttccatttttgttgactgatcaagtagacatggctccctggtgagttactgtattacagtaaaaaaaaaaccgaaaacttttagatactgtaaagataaactttgaaggctttcttgcagtattatgatgaatgtttgttgatttgtgtactaaaacttcaatccaatgttgtagtgtggacagtatttctgaaaaggaacaacaataatgtgaagctcccattttactggattttgtatccttttttatgggagttacagtaaaaaaattctgaatctataccatgagcttgattattagcatgtaacagttgaatgatttttccttcccatttttatcagattttgtttgtatggaagtgttgctatatttgattgggaatgacctgttttgttcatcagtttatatgactggttagtaagacatgtctgatgtctaaaagggtatggactacaagccaataaacaactacttcgtgttttttttttaatgttataattgactatttgatgtttcacgtttgtcaatgcgaaactttagcacaactggttagcaagagatcacatgtctgatgtctttatccatttgaatgggccatatgttggccatatacatttctaaaaaggtatgggctacaacgaggttgttttttcggatatcagaacacacatatcagctaaaagacaaatagctaaaagacaaaaaaggaagtaccatttatgttaaaaaagtatcattctgtaaaaaannnnnnnnnnnnnnnnnnnnatttttgtttaaccggtgaaaaagggtaaattataccaccgttaatttgttgacacatcatcaaacgtactgaaaaatgagaatgaaagacaataaatatgtcattttaaccaatagaaaaacatgatgagtaagatccttaattgatagataaataattaaatatcagtccattagttgaatattcaatgaaaatgtatggtccaaaaatggcgtttaatagtcaatgtcatgctttatggggtggtggagtactatgtgactgtgtgtggacttggagaagactagagagtatgattatcaacatatagaccctgaaaatgaaaatgaaaatgatgtttttacactttaaaatcgtcaagaaacaacaatcctttttagcaatagtatttacacgcgctagttgcacgaactttaatgcaaatagtataaatttacggtcaaagttttcatactttagacacatactctctccgtcccttaatactcgcaccgctttccttttcgggccgtcccttaatacttgcaccgcttctataaatggaaatctatttctcacaattacctactaacccacctacactcatcgtccctacaaaaaatcatttaaaaattcacaccccacactcaccactcctcacccattacacatttcctactaactatattaaaaaaatatcccactataaactaacactcattaaattaataagtcaattcaaatatcttaaactccgcaccggtcaaatcggtgcgagtattaagggacggagggagtattatagagtgtaaataactttcatgaatggagggagtaaaaaattgttttacttggctaaaatacttttgttcttattggcagataaacatgagtccattattggccaacttgaacatatacctccaaacaataatcaataatgtcgattatgaagtttgtgaatgcaatttattatcactttcattgcaagttgtcatctgtgctgagtgttgatttataaaaaggactacttgattaacacatacaatattactccacctttctccagacaacctttcaattctgctttatcttgttttctcatcattcattcatctcttcatctttctgaaaacacaaccca

SEQ ID NO: 98 - DNA, 3462 bp, Spinacia oleracea
atggctgaaatcggatactcggtttgttcaaaacttattgaagtgatgggcagtaagatcattaaagagatttgcgacatgtggggttacaattctcatcttgacgacctcaacaaatctgtcttgacgatcaaggatgtgctcttggatgctgaggcgaagcgggatctttcccgtgaacaacagagttacattgcagaacttaaggatgttgtttacgatgctgatgatttgttcgatgagttcctcactcttgctgagctcaaacagattgatggcaacaacaagggtggtggtaaattctccaaaaaggtacgtcgtttcttttcttctaataaggagaagatgggtcaagcttacaagatgtctcatatggttaaagaaattaagaagcagttgggtgaaattgttgataggtataccaaatttgggtttattgttgattataaacctattattaggagaagggaggaaacatgttcttattttgtaggtgccaaggagattgttgggagggataaggataaagatgttatcataggcatgttgctagatcatgataacgattgtagtttcttggctgttgtgggggttggaggggtgggaaaaactactcttgcccaacttgtgtataatgatgaaagagtcaaaagtgagttccaagatttgaggtattgggtttgtgtctctgatcaagatgggggacaatttgatgacaaaagaattctttgtaagattatagagttagttacgggccagattcctccgagtaacgagagcatggaatcggtgcgtaagaaatttcaagaggaattaggaggaaagaagtacttccttgttcttgatgatgtatggaacgaggatcgccagaagtggcttcatctagaaaatttcttgaaattgggtcaagggggaagcaagattgtggtaaccacacgttcagagaagacggcaaatgttatagggaaaagacaagactataaactagaatgtttgtcagcagaggattcatggcgcttatttgaaatgtcagcttttgacgaagggcatggccaggaaaactatgacgaattagtgacgattggcaagaagattgttgaaaaatgttataacaatccacttgctataacagtggtaggaagccttctttttggacaagagataaataagtggcggtcgtttgaaagcagtggattagcccaaattgccaatggtgataatcagattttcccgatattaaagctcagttaccacaatcttccacactccttgaagagctgctttagctattgtgcagtgtttcccaaagattatgaaataaagaaggagatgttgattgatctttggatagcacaaggatacattataccgttggatggaggtcaaagtatagaagatgctgccgaggaacattttgtaattttgttaagaagatgtttctttcaagatgtaaagaaggattctcttggtaatgttgattatgttaaaatccacgacttaatgcacgatgtcgctcaagaagtggggaaggaggaaatctgtgtagtgacttcaggtacaaagaagttggctgataaaatccgtcacgtgggttgtgttgtcgatagagatccagaaatagtctttttatgtagcaataagattcgttcgtatattagcggtcgttgtataaagaatccggtggattcacaaatagacaactggatgcgccttagggtgttggacttgtcagattcatgtgttaaagatttgtctgattcaataggtaagctgctgcacttaaggtatcttaacctctcttctaatataaagttggagataatccctgatgcaattacaagactgcataacttgcagacactgcttttaaaagattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaacttacagagttggataacttagagtacatggagagtagaagcagcagcagtagcagtgacacagaagcagcaacaccagaattaccaacattcttcccttcccttgaaaaacttacactttggggtctggaaaagttgaagggtttggggaacaggagatcgagtagttttccccgcctctctaaattggaaatctgggaatgcccagatctaacgtcatttccttcttgtccaagccttgaaaagttggaattgaaagaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatctgggttatctcaaatcactgcccacaaattgtctgactcacctcgaccttacaataagtgattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatacctgcgcatatactactgtccagccctgaaatcactaccagaagcaatgcggaacctcacctcccttcagacacttgggatatcggattgtccagacctagttaaaagatgcagaaaacccaacggcaaggactatcccaaaattcaacacatccccaaaattattagagggtag

SEQ ID NO: 99 - DNA, 3486 bp, Spinacia oleracea
atggctgaaatcggatactcggtttgttcaaaacttattgaagtgatgggcagtaagatcattaaagagatttgcgacatgtggggttacaattctcatcttgacgacctcaacaaatctgtcttgacgatcaaggatgtgctcttggatgctgaggcgaagcgggatctttcccgtgaacaacagagttacattgcagaacttaaggatgttgtttacgatgctgatgatttgttcgatgagttcctcactcttgctgagctcaaacagattgatggcaacaacaagggtggtggtaaattctccaaaaaggtacgtcgtttcttttcttctaataaggagaagatgggtcaagcttacaagatgtctcatatggttaaagaaattaagaagcagttgggtgaaattgttgataggtataccaaatttgggtttattgttgattataaacctattattaggagaagggaggaaacatgttcttattttgtaggtgccaaggagattgttgggagggataaggataaagatgttatcataggcatgttgctagatcatgataacgattgtagtttcttggctgttgtgggggttggaggggtgggaaaaactactcttgcccaacttgtgtataatgatgaaagagtcaaaagtgagttccaagatttgaggtattgggtttgtgtctctgatcaagatgggggacaatttgatgacaaaagaattctttgtaagattatagagttagttacgggccagattcctccgagtaacgagagcatggaatcggtgcgtaagaaatttcaagaggaattaggaggaaagaagtacttccttgttcttgatgatgtatggaacgaggatcgccagaagtggcttcatctagaaaatttcttgaaattgggtcaagggggaagcaagattgtggtaaccacacgttcagagaagacggcaaatgttatagggaaaagacaagactataaactagaatgtttgtcagcagaggattcatggcgcttatttgaaatgtcagcttttgacgaagggcatggccaggaaaactatgacgaattagtgacgattggcaagaagattgttgaaaaatgttataacaatccacttgctataacagtggtaggaagccttctttttggacaagagataaataagtggcggtcgtttgaaagcagtggattagcccaaattgccaatggtgataatcagattttcccgatattaaagctcagttaccacaatcttccacactccttgaagagctgctttagctattgtgcagtgtttcccaaagattatgaaataaagaaggagatgttgattgatctttggatagcacaaggatacattataccgttggatggaggtcaaagtatagaagatgctgccgaggaacattttgtaattttgttaagaagatgtttctttcaagatgtaaagaaggattctcttggtaatgttgattatgttaaaatccacgacttaatgcacgatgtcgctcaagaagtggggaaggaggaaatctgtgtagtgacttcaggtacaaagaagttggctgataaaatccgtcacgtgggttgtgttgtcgatagagatccagaaatagtctttttatgtagcaataagattcgttcgtatattagcggtcgttgtataaagaatccggtggattcacaaatagacaactggatgcgccttagggtgttggacttgtcagattcatgtgttaaagatttgtctgattcaataggtaagctgctgcacttaaggtatcttaacctctcttctaatataaagttggagataatccctgatgcaattacaagactgcataacttgcagacactgcttttaaaagattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaacttacagagttggataacttagagtacatggagagtagaagcagcagcagtagcagtgacacagaagcagcaacaccagaattaccaacattcttcccttcccttgaaaaacttacactttggggtctggaaaagttgaagggtttggggaacaggagatcgagtagttttccccgcctctctaaattggaaatctgggaatgcccagatctaacgtcatttccttcttgtccaagccttgaaaagttggaattgaaagaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatctgggttatctcaaatcactgcccacaaattgtctgactcacctcgaccttacaataagtgattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaagacaacatcatattctggaaatcctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatacctgcgcatatactactgtccagccctgaaatcactaccagaagcaatgcggaacctcacctcccttcagacacttgggatatcggattgtccagacctagttaaaagatgcagaaaacccaacggcaaggactatcccaaaattcaacacatccccaaaattagggtagtaattctcatttactcaacactagcttga

SEQ ID NO: 100 - protein, 1153 aa, Spinacia oleracea
MAEIGYSVCSKLIEVMGSKIIKEICDMWGYNSHLDDLNKSVLTIKDVLLDAEAKRDLSREQQSYIAELKDVVYDADDLFDEFLTLAELKQIDGNNKGGGKFSKKVRRFFSSNKEKMGQAYKMSHMVKEIKKQLGEIVDRYTKFGFIVDYKPIIRRREETCSYFVGAKEIVGRDKDKDVIIGMLLDHDNDCSFLAVVGVGGVGKTTLAQLVYNDERVKSEFQDLRYWVCVSDQDGGQFDDKRILCKIIELVTGQIPPSNESMESVRKKFQEELGGKKYFLVLDDVWNEDRQKWLHLENFLKLGQGGSKIVVTTRSEKTANVIGKRQDYKLECLSAEDSWRLFEMSAFDEGHGQENYDELVTIGKKIVEKCYNNPLAITVVGSLLFGQEINKWRSFESSGLAQIANGDNQIFPILKLSYHNLPHSLKSCFSYCAVFPKDYEIKKEMLIDLWIAQGYIIPLDGGQSIEDAAEEHFVILLRRCFFQDVKKDSLGNVDYVKIHDLMHDVAQEVGKEEICVVTSGTKKLADKIRHVGCVVDRDPEIVFLCSNKIRSYISGRCIKNPVDSQIDNWMRLRVLDLSDSCVKDLSDSIGKLLHLRYLNLSSNIKLEIIPDAITRLHNLQTLLLKDCRSLKELPKDFCKLVKLRHLDLRGCQCLIGMPLGMDRLISLRVLPKVVVGKKEQSDDQLKALKGLTEIKGSIDITIYSKYRIVEGMNDTGGAGYLKSMKHLTGVDIRFDDREGGFVNPEAVLATLEPPSNIKSLSIHRFDGKTLPVWGRAEINWAISLSHLVDIQLWHCRNLQEMPVLSKLPHLKSLELTELDNLEYMESRSSSSSSDTEAATPELPTFFPSLEKLTLWGLEKLKGLGNRRSSSFPRLSKLEIWECPDLTSFPSCPSLEKLELKENNEALQIIVKITTTRGKEEKEEDKNAGVGNSQDDDNVKLWKVEIDNLGYLKSLPTNCLTHLDLTISDSKEGEGEWEVGDAFQKCVSSLRSLTIIGNHGINKVKRLSGRTGLEHFTLLESLKLSDIEDQEDEGEDNIIFWKSFPQNLRSLRIKDSDKMTSLPMGMQYLTSLQTLYLHHCYELNSLPEWISSLSSLQYLRIYYCPALKSLPEAMRNLTSLQTLGISDCPDLVKRCRKPNGKDYPKIQHIPKIIRG

SEQ ID NO: 101 - protein, 1161 aa, Spinacia oleracea
MAEIGYSVCSKLIEVMGSKIIKEICDMWGYNSHLDDLNKSVLTIKDVLLDAEAKRDLSREQQSYIAELKDVVYDADDLFDEFLTLAELKQIDGNNKGGGKFSKKVRRFFSSNKEKMGQAYKMSHMVKEIKKQLGEIVDRYTKFGFIVDYKPIIRRREETCSYFVGAKEIVGRDKDKDVIIGMLLDHDNDCSFLAVVGVGGVGKTTLAQLVYNDERVKSEFQDLRYWVCVSDQDGGQFDDKRILCKIIELVTGQIPPSNESMESVRKKFQEELGGKKYFLVLDDVWNEDRQKWLHLENFLKLGQGGSKIVVTTRSEKTANVIGKRQDYKLECLSAEDSWRLFEMSAFDEGHGQENYDELVTIGKKIVEKCYNNPLAITVVGSLLFGQEINKWRSFESSGLAQIANGDNQIFPILKLSYHNLPHSLKSCFSYCAVFPKDYEIKKEMLIDLWIAQGYIIPLDGGQSIEDAAEEHFVILLRRCFFQDVKKDSLGNVDYVKIHDLMHDVAQEVGKEEICVVTSGTKKLADKIRHVGCVVDRDPEIVFLCSNKIRSYISGRCIKNPVDSQIDNWMRLRVLDLSDSCVKDLSDSIGKLLHLRYLNLSSNIKLEIIPDAITRLHNLQTLLLKDCRSLKELPKDFCKLVKLRHLDLRGCQCLIGMPLGMDRLISLRVLPKVVVGKKEQSDDQLKALKGLTEIKGSIDITIYSKYRIVEGMNDTGGAGYLKSMKHLTGVDIRFDDREGGFVNPEAVLATLEPPSNIKSLSIHRFDGKTLPVWGRAEINWAISLSHLVDIQLWHCRNLQEMPVLSKLPHLKSLELTELDNLEYMESRSSSSSSDTEAATPELPTFFPSLEKLTLWGLEKLKGLGNRRSSSFPRLSKLEIWECPDLTSFPSCPSLEKLELKENNEALQIIVKITTTRGKEEKEEDKNAGVGNSQDDDNVKLWKVEIDNLGYLKSLPTNCLTHLDLTISDSKEGEGEWEVGDAFQKCVSSLRSLTIIGNHGINKVKRLSGRTGLEHFTLLESLKLSDIEDQEDEGEDNIIFWKSFPQNLRSLRIKDSDKMTSLPMGMQYLTSLQTLYLHHCYELNSLPEWISSLSSLQYLRIYYCPALKSLPEAMRNLTSLQTLGISDCPDLVKRCRKPNGKDYPKIQHIPKIRVVILIYSTLA

SEQ ID NO: 102 - DNA, 7116 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaggatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcaaggtcggatgttaaaaatttgcctaattcaataggtaaattgttgcacttgaggtatcttaacctgtcagataatagaaatctaaagatacttcctgatgcaattacaagactgcataatttgcagacactacttttagaacgttgcgaaagtttaaaggagttgccaaaagatttttgcaaattggtcaaactgagacacttggatttaaggggatgtttttctttgattggtatgccattgggaatggataggctaattagtcttagaatactaccaaacattgtggtgggtaggaaggaacaaagtgatgatgatgagctgaaagccctaaaaggcctcaccgagataaaaggctccattcgtattagaatctattcaaagtatagaatagttgaaggcatgaatgacacaggaggagctgggtatttaaagagcatgaaacatctcacgggggttgatattacatttgatggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggcgtctggacaagttgaagggttttgggaacaggagatcgagtagttttccccgcctctctaaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcgaactttcaaagatagaagaccaggaagatgagggcgaagacaacatcatattctggaaatcctttcctcaaaacctccgcagtttggaaattaaaggctcttgcaaaatgacaagtttgcccatggggatgcagtacttaacctccctccaaaccctcaaactagaaaattgtgatgaattgaattcccttccagaatggataagcagcttatcatctcttcaatacctgggcatattcaactgtccagccctagaatcactaccagaagcaatgcggaacctcacctcccttcagagacttgtgatacggctgtgtccagacctagttaaaagatgcggaaaacccaaaggcaaggactatcccaaaattcaacacatccccgaaattgtaagtgattgcagaaagtattttattcatttatatttattttatgcttagaatgatatacaccgtcgtcctttggtttcaaatcttgaatttggtttttgttttctttctttgtttctttattcaacaccagcccatttatgattgattcattaaaaaaaggatggagttttgtgtatttgaagaagacaacgaattgagattcctggggttttctttttgttggggttggatttcatgtatatgttgctgattaaatacgagactgatgatgatgatgatgtgtttatgggttttaaatcagattaaatatatgggaaatgtaagttaatttgggatgcacataaggtgtttgctgaaatgtctatgagaaatgttgtttcttggacttagaatgatatacactgtcgtccattggtttccaatcttacatttggtttgtgttttcttagtttgtttctttaatcaacaccaacccatttttttaaaactacctgcaactactaatttacgttgaccctgtatctcaggtactaaatgaatattggtgattttcagttactcaacactagcttgatcctgaacgcacccaaccttcaggttagaatccggcttactcatccttttgtccagttttcaagtaattgttttggcaggatcaattctctaattgttgtacaccgtatattgcaatttatagtgactacagttaatgaatgtttacaaaaaattagtcatgtaaaaacttcttctctgtccattacataaactctttttctctttctaacttatcatgttcatgtctaaaaaattaaacatgctcacatcaatgttcatttaagctaacttacttctgtaagagagcgagctagttaaaaactcctttaactttctgttttatactcaggacatggattgatgcaagcatgaagaacttcgggaatttgctaaaactctaccaaagcgatgagagtttggactttgtttcacttgaagtcagggactgtcaacaaagccacagtgtgcatgttggctgtttcacttggacgataaaaaggtttatttaattgttttcctaagtgtatttggcttacaagcttttacttttcgcttgaaagggtttttcttgttttaagctttttgaattagagtttcggttgaagtaagagtagtcgtattagtcttttactttgcaggagtctatgcctatataaggtaagactcgtatttgtaattttcagattatgcaattcaagttttcgagtgttttcttaaaaaaacatatcatacctgtgtgtagcataaagataaattctgatgctgtgcttcttgttatggctcacattggttttcattgtttggattgtttcacagggaagcagagaatacctggaacctgtaaaggacgctatatctatagcagctttcacaggccaagtaatataatgttctttatcaatcactcaatacctggagattgtttgaacacataattcacctctttttttccatctcaaattgcagacttttactgggatttgaatgacagcaaacatttgattgtcacgaggattgatctaactggtgaatgttgtgatcaccatattggtctttctcattcaaacaaacttgcataccgttcttttgaagtttgaagacaagcaggcgataatcaactcaggtcgaagctcatgtgcaggagagaatagaatatagaggagattatttttaaaagaaacgctcaaaggtattgtagcacctttcctatttgctactgcagtgatgtttttatttcttgtttgcagcgcttgtttctcatatttcaacctacttttagaaaaaaaaacatctccgaacataaccaaaaataaagttcccttatcagtgctttccctgctttcttctaaacaacatatacaattataaaccctttttctctcttacctttgttattcttccttgcttcattgagataacactctcctgtttttgttttgttgttagtcattacatggatatatcaaggacaacagttctgtagtccgtcaactgtggttaggaaggctaaactggagcacaataaccccatgtcaattgaatagtaaaggtgtgctatatcagtttcgtttggcttggcttacctgaaaaatggctggttatttatccttgtctctttctatgacgtgcagtggcttgttaatgtgtctcggacaacaattcctcactttccaagttccatacacgctgatgtaactatcttctgcagtctgttctttcatttttgccacgtgctctaattataactttttgtactcaataatcaactccttgtcccggtatttgcagagactacttaaacaggtaaagtgacaatcctggcgaagttgtctgtttcttagctctgaacccatcattcaggtaagattaagtatttaagaagaaattttgtttttacctaaaatgaatgatcttgtgtaactgcttgcttcttgcattaaataagaactttctgctgcatatgtgacagttacatccacaaaaaagttggaggtttgttcagggattggaaatgaaggtacttcagaattcctggaatgtttatgaatgctccagacttcagagtctttaatggaaaattcgagtcactaaaaaaacattattcctatcatcagagctttgaagttcctctatacaaggtcaactgagttcctctttgcctcttgtttaattgtatttacttgtaccttaattataatctgtatattgttttagttaagttctaaaacaggttattattcatcatttgtgcagcatattgctggaatcaagaatctagtgcttcttcttcctgacttcactgtcaaaatagcagttcccatgctggaaataagcgcgctagcaatgtaattgatgacatggatgttgctgcttctgagttttgatcataaaaagctgttatgtgtttcttgaatgtaatgaaggagaggagaaaactgaaaactcttggcaaaaacgtgaaattgcagtgcctcggggtggtagggatcacccggattcagttcagacgatacttttttcaacccggtttgttccggttttcagcttcgggttttccttgtacttttggggcacacatacaaggctacttcatgtttgagaaacctaattgaggctatcttgtagcaaatgcacaccacactctttctctcttctctccttttttcaccttccatttgtaaaaatcctcttttaaaggttaataaaaaaaagcttcaagtctcgtagggtggatgtaggtcacattgaccgaaccacggtaaactctttgtgttctttcttctctctttgtttctcatttttacggcaagtgtttatggttaaccatgcatcttagaatagcttaaggcattaacataataacatcaatgttctccaaagattcaccttacttgttgtacataatcacaatgttaagcctatgaaggtagaatgctctcatgatttggtttaaccaaaaaataaactctaaaataatacggagtaataaaaattggccataaattatttacaaagtttgatttttgtatagggtatcttgtacttgtgataaaaaaaattaaaaaaaaaaaaattacttatttcttc

SEQ ID NO: 103 - DNA, 2000 bp, Spinacia oleracea
tttgaagttaggcttaacttgctcaccaattcttaaatagactcgacttacactgaatttattgtgtactatgtctagaaagtaaggtcaacaactttcttctaaattattttggcatgtttattagggttattatgaaaaacatatcaaattggtgttgttagttaggcttgaataatatgattttaagtcacgagacttttataaattaggtaatttgatttaaaaaattgttacatatctaagaaaatggatgttaaatttatcagtcaatgtataaacaataaaagtcaatatgtatgtaaaagggttgctagataaaatctttggttttttggtccacaactccacactaagaggaactccaatgcttagttacaaggtggtgtagttaaaaagtaactccaatagttaactacacggtattatagttaaatttgccaactcaaatttctaactacaatatatttaagctacaaagtttctcattggctgactacaatacgttgtagcgccttataatattttattcaatatacaattttatttattttacctttttaacaatttttttttgatctacctgctgtcctgttcatatgagctacactaatttgatagctgcttacgcaattcttatatcaacggttggctacttgttcaaatatttttatttttttacgagtaagtcattttatgatcattgaagtggctctattattattatcatgcaccgattaacgcaagaataattaactcggtacgaattagtttcaaaataaaatccctcaaaaaaaaaagtttcaaaataaaattaacagaaaaccaaccttctccggtttactgttgttagagcatggaattttccagtaatcgcagaccccaaattatcttccagttgaatcaatccttgatttttggatttgccagaaaactccttgaattttagggttcatatttgatccgtaattgggaaaattttcagcaattgatcttccaaatcagccctacttgtttccagactgcaaatgaaaggtgcgaactttatactgcattttggttttccattagtgtaatttattaagatgaactgcattttgcaattgttttattcgactactcatttttaaatcaaattgcttaattgctagttagttttcttatcatattgccaaaaaaaattatttttgtttaattggtgaaaaagggtaaattatacctagtgtacaagattttcttgcacaccaccgttaatttgttgacacatcatcaaacgtactgaaaaatgagaatgaaagacaataaatatgtcattttaaccaatagaaaaacatgatgtagtaagatccttaattgatagataaataattaaatatcagtccattagttgaatattcaatgaaaatgtatggtccaaaaatggcgtttaatagtcaatgtcatgctttatggggtggtggagtactatgtgactgtgtgtggacttggagaagactagagagtatgattatcaacctatggaccctcaaaatgaaaatgaaaatgatgtttacacgtgctatttgcacggacttcaatgcaaatagtataaatttacggtcaaagttttcattctaaagcgtaaataactttcatgaatggaggacggtagtataagtataacgttatagcctacaattttcttatcatattcatataaatttgtttctaaaagttgttttacttggctaaaatacttttgttcttattggcagataaacatcagtacgtccattattggccaacttgctgagtccattattggccaacttgaacatatacctccaaacaataatcaataatgtcgattatgaagtttgtgaatgcaatttattatcactttcatttataaaatgactacttgattaacacatacaatattacctttctccaaacaccctttcaattctgcttaatcttgttttctcatcatctcttcatctttctgaaaacacaaccca

SEQ ID NO: 104 - DNA, 3492 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaggatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcaaggtcggatgttaaaaatttgcctaattcaataggtaaattgttgcacttgaggtatcttaacctgtcagataatagaaatctaaagatacttcctgatgcaattacaagactgcataatttgcagacactacttttagaacgttgcgaaagtttaaaggagttgccaaaagatttttgcaaattggtcaaactgagacacttggatttaaggggatgtttttctttgattggtatgccattgggaatggataggctaattagtcttagaatactaccaaacattgtggtgggtaggaaggaacaaagtgatgatgatgagctgaaagccctaaaaggcctcaccgagataaaaggctccattcgtattagaatctattcaaagtatagaatagttgaaggcatgaatgacacaggaggagctgggtatttaaagagcatgaaacatctcacgggggttgatattacatttgatggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggcgtctggacaagttgaagggttttgggaacaggagatcgagtagttttccccgcctctctaaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcgaactttcaaagatagaagaccaggaagatgagggcgaagacaacatcatattctggaaatcctttcctcaaaacctccgcagtttggaaattaaaggctcttgcaaaatgacaagtttgcccatggggatgcagtacttaacctccctccaaaccctcaaactagaaaattgtgatgaattgaattcccttccagaatggataagcagcttatcatctcttcaatacctgggcatattcaactgtccagccctagaatcactaccagaagcaatgcggaacctcacctcccttcagagacttgtgatacggctgtgtccagacctagttaaaagatgcggaaaacccaaaggcaaggactatcccaaaattcaacacatccccgaaattgtactaaatgaatattggtga

SEQ ID NO: 105 - DNA, 3525 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaggatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcaaggtcggatgttaaaaatttgcctaattcaataggtaaattgttgcacttgaggtatcttaacctgtcagataatagaaatctaaagatacttcctgatgcaattacaagactgcataatttgcagacactacttttagaacgttgcgaaagtttaaaggagttgccaaaagatttttgcaaattggtcaaactgagacacttggatttaaggggatgtttttctttgattggtatgccattgggaatggataggctaattagtcttagaatactaccaaacattgtggtgggtaggaaggaacaaagtgatgatgatgagctgaaagccctaaaaggcctcaccgagataaaaggctccattcgtattagaatctattcaaagtatagaatagttgaaggcatgaatgacacaggaggagctgggtatttaaagagcatgaaacatctcacgggggttgatattacatttgatggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggcgtctggacaagttgaagggttttgggaacaggagatcgagtagttttccccgcctctctaaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcgaactttcaaagatagaagaccaggaagatgagggcgaagacaacatcatattctggaaatcctttcctcaaaacctccgcagtttggaaattaaaggctcttgcaaaatgacaagtttgcccatggggatgcagtacttaacctccctccaaaccctcaaactagaaaattgtgatgaattgaattcccttccagaatggataagcagcttatcatctcttcaatacctgggcatattcaactgtccagccctagaatcactaccagaagcaatgcggaacctcacctcccttcagagacttgtgatacggctgtgtccagacctagttaaaagatgcggaaaacccaaaggcaaggactatcccaaaattcaacacatccccgaaattttactcaacactagcttgatcctgaacgcacccaaccttcaggacatggattga

SEQ ID NO: 106 - protein, 1163 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRGRGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTTRSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIELWMAQGYVVPLDGGQSIEDAAEEHFVILLRRCFFQDVKKDKYGDVDSVKIHDLMHDVAQEVGREELCVVNDNTKNLGDKIRHVHRDVIRYAQRVSLCSHSHKIRSYIGGNCEKRCVDTLIDKWMCLRMLDLSRSDVKNLPNSIGKLLHLRYLNLSDNRNLKILPDAITRLHNLQTLLLERCESLKELPKDFCKLVKLRHLDLRGCFSLIGMPLGMDRLISLRILPNIVVGRKEQSDDDELKALKGLTEIKGSIRIRIYSKYRIVEGMNDTGGAGYLKSMKHLTGVDITFDGGCVNPEAVLATLEPPSNIKRLEMWHYSGTTIPVWGRAEINWAISLSHLVDIQLWHCRNLQEMPVLSKLPHLKSLELYNLISLEYMESTSRSSSSDTEAATPELPTFFPSLEKLTLWRLDKLKGFGNRRSSSFPRLSKLEIWECPDLTWFPPCPSLKTLKLEKNNEALQIIVKITTTRGKEEKEEDKNAGVGNSQDDDNVKLRKVEIDNVSYLKSLPTNCLTHLKITGIDYREGEIESDSVEEEIELEVGEAFQKCASSLRSLIIIGNHGINKVMRLSGRTGLEHFTLLDSLELSKIEDQEDEGEDNIIFWKSFPQNLRSLEIKGSCKMTSLPMGMQYLTSLQTLKLENCDELNSLPEWISSLSSLQYLGIFNCPALESLPEAMRNLTSLQRLVIRLCPDLVKRCGKPKGKDYPKIQHIPEIVLNEYW

SEQ ID NO: 107 - protein, 1174 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRGRGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTTRSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIELWMAQGYVVPLDGGQSIEDAAEEHFVILLRRCFFQDVKKDKYGDVDSVKIHDLMHDVAQEVGREELCVVNDNTKNLGDKIRHVHRDVIRYAQRVSLCSHSHKIRSYIGGNCEKRCVDTLIDKWMCLRMLDLSRSDVKNLPNSIGKLLHLRYLNLSDNRNLKILPDAITRLHNLQTLLLERCESLKELPKDFCKLVKLRHLDLRGCFSLIGMPLGMDRLISLRILPNIVVGRKEQSDDDELKALKGLTEIKGSIRIRIYSKYRIVEGMNDTGGAGYLKSMKHLTGVDITFDGGCVNPEAVLATLEPPSNIKRLEMWHYSGTTIPVWGRAEINWAISLSHLVDIQLWHCRNLQEMPVLSKLPHLKSLELYNLISLEYMESTSRSSSSDTEAATPELPTFFPSLEKLTLWRLDKLKGFGNRRSSSFPRLSKLEIWECPDLTWFPPCPSLKTLKLEKNNEALQIIVKITTTRGKEEKEEDKNAGVGNSQDDDNVKLRKVEIDNVSYLKSLPTNCLTHLKITGIDYREGEIESDSVEEEIELEVGEAFQKCASSLRSLIIIGNHGINKVMRLSGRTGLEHFTLLDSLELSKIEDQEDEGEDNIIFWKSFPQNLRSLEIKGSCKMTSLPMGMQYLTSLQTLKLENCDELNSLPEWISSLSSLQYLGIFNCPALESLPEAMRNLTSLQRLVIRLCPDLVKRCGKPKGKDYPKIQHIPEILLNTSLILNAPNLQDMD

SEQ ID NO: 108 - DNA, 1597 bp, Spinacia oleracea
tcacgtgggttgtgttgtcgatagagatccagaaatagtctttttatgtagcaataagattcgttcgtatattagcggtcgctgcataaagaatccggtggattcacaaatagacaactggatgtgccttagggtgttggacttgtcagattcatgtgttaaagatttgtctgattcaataggtaagctgctgcacttaaggtatcttaacctctcttctaatataaagttggagataatccctgatgcaattacaagactgcataacttgcagacactacttttagaagattgcagaagtttaaaggagttgccaaaagatttttgcaaattggtcaaactgaggcacttggaattacagggttgtcatgatttgattggtatgtcatttggaatggataagctaactagtcttagaatactaccaaacattgtggtgggtaggaaggaacaaagtgttgatgatgagctgaaagccctaaaaggcctcaccgagataaaaggctccattgatatcacaatctattcaaaatatagaagagttgaaggcatgaatggcacaggaggaggagctgggtatttgaagagcatgaaacatctcacgggggttaatattacatttgatgaaggtggatgtgttaaccctgaagctgtgtatttgaagagcatgaaacatctcacgagggttattattatatttgattataaaggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatcacgcttgaagattgttacaatttgcaggagatgccagtgctgagtaaactgcctcatttgaaatcactggaacttacagagttggataacttagagtacatggagagtagaagcagcagcagtagcagtgacacagaagcagcaacaccagaattaccaacattcttcccttcccttgaaaaacttacactttggcgtctggacaagttgaagggttttgggaacaggagatcgagtagttttccccgcctctctaaattggaaatctggaaatgtccagatctaacgtcatttccttcttgtccaagccttgaagagttggaattgaaagaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatctgggttatctcaaatcactgcccacaaattgtctgactcacctcgaccttacaataagtgattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaa

SEQ ID NO: 109 - protein, 532 aa, Spinacia oleracea
HVGCVVDRDPEIVFLCSNKIRSYISGRCIKNPVDSQIDNWMCLRVLDLSDSCVKDLSDSIGKLLHLRYLNLSSNIKLEIIPDAITRLHNLQTLLLEDCRSLKELPKDFCKLVKLRHLELQGCHDLIGMSFGMDKLTSLRILPNIVVGRKEQSVDDELKALKGLTEIKGSIDITIYSKYRRVEGMNGTGGGAGYLKSMKHLTGVNITFDEGGCVNPEAVYLKSMKHLTRVIIIFDYKGGCVNPEAVLATLEPPSNIKRLEMWHYSGTTIPVWGRAEINWAISLSHLVDITLEDCYNLQEMPVLSKLPHLKSLELTELDNLEYMESRSSSSSSDTEAATPELPTFFPSLEKLTLWRLDKLKGFGNRRSSSFPRLSKLEIWKCPDLTSFPSCPSLEELELKENNEALQIIVKITTTRGKEEKEEDKNAGVGNSQDDDNVKLWKVEIDNLGYLKSLPTNCLTHLDLTISDSKEGEGEWEVGDAFQKCVSSLRSLTIIGNHGINKVKRLSGRTGLEHFTLLESLKLSDIEDQEDEGE

SEQ ID NO: 110 - DNA, 2180 bp, Spinacia oleracea
acaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactacttttagaagattgcagaagtttaaaggagttgccaaaagatttttgcaaattggtcaaactgaggcacttggaattacagggttgtcatgatttgattggtatgccatttggaatggataagctaactagtcttagaatactaccaaacattgtggtgggtaggaaggaacaaagtgatgatgagctgaaagccctaaaaggcctcaccgagataaaaggctccatttctatcagaatctattcaaagtatagaatagttgaaggcatgaatgacacaggaggagctgcttatttgaagagcatgaaacatctcagggagattgatattacatttttgggtgaatgtgttggccctgaagctgtattggaaaccttagagccaccttcaaatatcaagagcttatatatatataattacagtggtacaacaattccagtatggggaagagcagagattaattgggcaatctccctctcacatctcgtcgacatccagcttagttgttgtagtaatttgcaggagatgccagtgctgagtaaactgcctcatttgaaatcgctgaaacttggatggttggataacttagagtacatggagagtagcagtagcagtgacacagaagcagcaacaccagaattaccaacattcttcccttcccttgaaaaacttactttacagcatctggaaaagttgaagggttttgggaacaggagatcgagtagttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggggtctggaaaagttgaagggtttggggaacaggagatcgagtagttttccccgcctctctgaattgaaaatcatggaatgcccagatctaacgtggtttcctccctgtccaagccttgaaaaacttacactttggcgtctggacaagttgaagggttttgggaaccggagatcgagtacttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcaaatcactgcccacaaattgtcttactcacctcgaccttacaataagtgattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaa

SEQ ID NO: 111 - protein, 726 aa, Spinacia oleracea
KWMCLRMLDLSWSDVKNLPNSIGKLLHLRYLNLSDNRNLKILPDAITRLHNLQTLLLEDCRSLKELPKDFCKLVKLRHLELQGCHDLIGMPFGMDKLTSLRILPNIVVGRKEQSDDELKALKGLTEIKGSISIRIYSKYRIVEGMNDTGGAAYLKSMKHLREIDITFLGECVGPEAVLETLEPPSNIKSLYIYNYSGTTIPVWGRAEINWAISLSHLVDIQLSCCSNLQEMPVLSKLPHLKSLKLGWLDNLEYMESSSSSDTEAATPELPTFFPSLEKLTLQHLEKLKGFGNRRSSSFPRLSELEIKKCPDLTSFPSCPSLEKLELKESNEALQIIVKITTRGKEKEENNNAGVRNSQDDDKVKLRKMVIDNLGYLTGVDIRFDDREGGFVNPEAVLATLEPPSNIKSLSIHRFDGKTLPVWGRAEINWAISLSHLVDIQLWHCRNLQEMPVLSKLPHLKSLELYNLISLEYMESTSRSSSSDTEAATPELPTFFPSLEKLTLWGLEKLKGLGNRRSSSFPRLSELKIMECPDLTWFPPCPSLEKLTLWRLDKLKGFGNRRSSTFPRLSELEIKKCPDLTSFPSCPSLEKLELKESNEALQIIVKITTRGKEKEENNNAGVRNSQDDDKVKLRKMVIDNLGYLKSLPTNCLTHLDLTISDSKEGEGEWEVGDAFQKCVSSLRSLTIIGNHGINKVKRLSGRTGLEHFTLLESLKLSDIEDQEDEGE

SEQ ID NO: 112 - DNA, 1391 bp, Spinacia oleracea
acaagtggatgtgtcttaggatgttggacttgtcaaggtcggatgttaaaaatttgcctaattcaataggtaaattgttgcacttgaggtgtcttaacctgtcttataatgatctgttgatactccctgatgcaattacaagactgcataatttgcagacactgcttttaaaagattgcggaagtttaatggagttgccaaaagatttttgcaaattggtcaaactgagacacttggatttaagggattgtgatgatttgattggtatgccattgggaatggataggctaactagtcttagagtactgccattctttgtggtgggtaggaaggaacaaagtgttgacgatgagctgaaagccctaaaaggcctcaccgagataaaaggctccattgatatcacaatctattcaaagtatagaatagttgaaggcatgaatgacacaggagctgggtatttgaagagcatgaaacatctcagggagattggtattacatttgatggtggatgtgttaaccctgaagctgtgttggaaaccctagagccaccttcaaatatcaagagcttatctatagataattacgatggtacaacaattccagtatggggaagagcagagattaattgggcaatctccctctcacatcttgtcgacatttggttttgtggttgtagtaatttgcaggagatgccagtgctgagtaaactgcctcatttgaaatcactgtatctttttatgttttgtaagttagagtacatggagagtagaagcagcagcagtagcagtgacacagaagcagcaacaccagaattaccaacattcttcccttcccttgaaaaacttacactttggtatctggaaaagttgaagggtttggggaacaggagatcgagtagttttccccgcctctctaaattggaaatcaatgaatgcccagatctaacgtggtttcctccttgtccaagccttgaaacgttgaaattggtaaaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatcaatgttatctcaaatcactgcccacaaattgtcttactcacctcaacataaaagtaagagattccgaaggggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcaaattttcatatatagaagaccaggaagatgagggcgaa

SEQ ID NO: 113 - protein, 463 aa, Spinacia oleracea
KWMCLRMLDLSRSDVKNLPNSIGKLLHLRCLNLSYNDLLILPDAITRLHNLQTLLLKDCGSLMELPKDFCKLVKLRHLDLRDCDDLIGMPLGMDRLTSLRVLPFFVVGRKEQSVDDELKALKGLTEIKGSIDITIYSKYRIVEGMNDTGAGYLKSMKHLREIGITFDGGCVNPEAVLETLEPPSNIKSLSIDNYDGTTIPVWGRAEINWAISLSHLVDIWFCGCSNLQEMPVLSKLPHLKSLYLFMFCKLEYMESRSSSSSSDTEAATPELPTFFPSLEKLTLWYLEKLKGLGNRRSSSFPRLSKLEINECPDLTWFPPCPSLETLKLVKNNEALQIIVKITTTRGKEEKEEDKNAGVGNSQDDDNVKLWKVEIDNQCYLKSLPTNCLTHLNIKVRDSEGEEIELEVGEAFQKCASSLRSLIIIGNHGINKVMRLSGRTGLEHFTLLDSLKFSYIEDQEDEGE

SEQ ID NO: 114 - DNA, 1516 bp, Spinacia oleracea
tcacgtgggttgtgttgtcgatagagatccagaaatagtctttttatgtagcaataagattcgttcgtatattagcggtcgttgtataaagaatccggtggattcacaaatagacaactggatgcgccttagggtgttggacttgtcagattcatgtgttaaagatttgtctgattcaataggtaagctgctgcacttaaggtatcttaacctctcttctaatataaagttggagataatccctgatgcaattacaagactgcataacttgcagacactacttttagaatattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattagatttgatgatagagaaggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagcttagtttttgtagaaatttgcaggagatgccagtgctgagtaaactgcctcatttgaaatcactggaacttacagagttggataacttagagtacatggagagtagaagcagcagcagtagcagtgacacagaagcagcaacaccagaattaccaacattcttcccttcccttgaaaaactttcactttggggtctggaaaagttgaagggtttggggaacaggagatcgagtagttttccccgcctctctaaattggaaatctgggaatgcccagatctaacgtcatttccttcttgtccaagccttgaaaagttggaattgaaagaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatctgggttatctcaaatcactgcccacaaattgtcttactcacctcgaccttacaataagagattccaaggagggggagggtgaatgggaagttggggaggcatttcagaagtgtgtatcttctttgagaaagctcagcataatcggaaatcacggaataaataaagtgaagagactgtctggaagaacagggttggagcatttcactctgttggactcactcgaactttcaaatatagaagaccaggaagatgagggcgaa

SEQ ID NO: 115 - protein, 505 aa, Spinacia oleracea
HVGCVVDRDPEIVFLCSNKIRSYISGRCIKNPVDSQIDNWMRLRVLDLSDSCVKDLSDSIGKLLHLRYLNLSSNIKLEIIPDAITRLHNLQTLLLEYCRSLKELPKDFCKLVKLRHLDLRGCQCLIGMPLGMDRLISLRVLPKVVVGKKEQSDDQLKALKGLTEIKGSIDITIYSKYRIVEGMNDTGGAGYLKSMKHLTGVDIRFDDREGGCVNPEAVLATLEPPSNIKRLEMWHYSGTTIPVWGRAEINWAISLSHLVDIQLSFCRNLQEMPVLSKLPHLKSLELTELDNLEYMESRSSSSSSDTEAATPELPTFFPSLEKLSLWGLEKLKGLGNRRSSSFPRLSKLEIWECPDLTSFPSCPSLEKLELKENNEALQIIVKITTTRGKEEKEEDKNAGVGNSQDDDNVKLWKVEIDNLGYLKSLPTNCLTHLDLTIRDSKEGEGEWEVGEAFQKCVSSLRKLSIIGNHGINKVKRLSGRTGLEHFTLLDSLELSNIEDQEDEGE

SEQ ID NO: 116 - DNA, 1403 bp, Spinacia oleracea
acaagtggatgtgtcttaggatgttggacttgtcaaggtcggatgttaaaaatttgcctaattcaataggtaaattgttgcacttgaggtatcttaacctgtcagataatagaaatctaaagatacttcctgatgcaattacaagactgcataatttgcagacacttcttttagtagattgcagaagtttaaaggagttgccaaaagatttttgcaaattggtcaaactgaggcacttggaattacagggttgtcatgatttgattggtatgccatttggaatggataagctaactagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggacctttataatttgattagtttagagtacatggagagcacaagcagaagcagtagcagtgacacagaagcagcaacaccagaattaccaacattcttcccttcccttgaaaaacttacactttggcgtctggacaagttgaagggttttgggaacaggagatcgagtagttttccccgcctctctgaattggaaatctgggaatgcccagatctaacgtcatttccttcttgtccaagccttgaagagttggaattggaagaaaacaatgaagcgttgcaaataatagtaaaaataacaacaacaagaggtaaagaagaaaaagaagaagacaagaatgctggtgttggaaattcacaagatgatgacaatgtcaaattatggacggtggaaatagacaatctgggttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggactcactcaaattttcaaagatagaagaccaggaagatgagggcgaa

SEQ ID NO: 117 - protein, 467 aa, Spinacia oleracea
KWMCLRMLDLSRSDVKNLPNSIGKLLHLRYLNLSDNRNLKILPDAITRLHNLQTLLLVDCRSLKELPKDFCKLVKLRHLELQGCHDLIGMPFGMDKLTSLRVLPKVVVGKKEQSDDQLKALKGLTEIKGSIDITIYSKYRIVEGMNDTGGAGYLKSMKHLTGVDIRFDDREGGFVNPEAVLATLEPPSNIKSLSIHRFDGKTLPVWGRAEINWAISLSHLVDIQLWHCRNLQEMPVLSKLPHLKSLDLYNLISLEYMESTSRSSSSDTEAATPELPTFFPSLEKLTLWRLDKLKGFGNRRSSSFPRLSELEIWECPDLTSFPSCPSLEELELEENNEALQIIVKITTTRGKEEKEEDKNAGVGNSQDDDNVKLWTVEIDNLGYLKSLPTNCLTHLDLTIRDSKEGEGEWEVGDAFQKCVSSLRSLTIIGNHGINKVKRLSGRTGLEHFTLLDSLKFSKIEDQEDEGE

SEQ ID NO: 118 - DNA, 1403 bp, Spinacia oleracea
acaagtggatgtgtcttaggatgttggacttgtcaaggtcggatgttaaaaatttgcctaattcaataggtaaattgttgcacttgaggtatcttaacctgtcagataatagaaatctaaagatacttcctgatgcaattacaagactgcataatttgcagacacttcttttagtagattgcagaagtttaaaggagttgccaaaagatttttgcaaattggtcaaactgaggcacttggaattacagggttgtcatgatttgattggtatgccatttggaatggataagctaactagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggggtctggaaaagttgaagggtttggggaacaggagatcgagtagttttccccgcctctctaaattggaaatctgggaatgccctgatctaacgtcatttccttcttgtccaagccttgaagagttggaattggaagaaaacaatgaagcgttgcaaataatagtaaaaataacaacaacaagaggtaaagaagaaaaagaagaagacaagaatgctggtgttggaaattcacaagatgatgacaatgtcaaattatggacggtggaaatagacaatctgggttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggactcactcaaattttcaaagatagaagaccaggaagatgagggcgaa

SEQ ID NO: 119 - protein, 467 aa, Spinacia oleracea
KWMCLRMLDLSRSDVKNLPNSIGKLLHLRYLNLSDNRNLKILPDAITRLHNLQTLLLVDCRSLKELPKDFCKLVKLRHLELQGCHDLIGMPFGMDKLTSLRVLPKVVVGKKEQSDDQLKALKGLTEIKGSIDITIYSKYRIVEGMNDTGGAGYLKSMKHLTGVDIRFDDREGGFVNPEAVLATLEPPSNIKSLSIHRFDGKTLPVWGRAEINWAISLSHLVDIQLWHCRNLQEMPVLSKLPHLKSLELYNLISLEYMESTSRSSSSDTEAATPELPTFFPSLEKLTLWGLEKLKGLGNRRSSSFPRLSKLEIWECPDLTSFPSCPSLEELELEENNEALQIIVKITTTRGKEEKEEDKNAGVGNSQDDDNVKLWTVEIDNLGYLKSLPTNCLTHLDLTIRDSKEGEGEWEVGDAFQKCVSSLRSLTIIGNHGINKVKRLSGRTGLEHFTLLDSLKFSKIEDQEDEGE

SEQ ID NO: 120 - DNA, 1466 bp, Spinacia oleracea
acaagtggatgtgtcttaggatgttggacttgtcatggtcggatgttaaaaatttgcctaattcaataggtaaattgttgcacttgaggtgtcttaacctgtcttataataaagatctgttgatactccctgatgcaattacaagactgcataatttgcagacactgcttttaaaagagtgcagaagtttaaaggagttgccaaaagatttttgcaaattggtcaaactgaggcacttggatttaaggtgttctgatttgaaggagttgccaaaagatttttgcaaattggtcaaactgaggcacttggatttatggggttgtgatgatttgattggtgtgccattgggaatggataggctaattagtcttagagtactgccattctttgtggtgggtaggaaggaacaaagtgatgatgatgagctgaaagccctaaaaggcctcaccgagataaaaggctccattcgtattagaatctattcaaagtatagaatagttgaaggcatgaatgacacaggaggagctgggtatttaaagagcatgaaacatctcacgggggttgatattacatttgatggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggcgtctggacaagttgaagggttttgggaacaggagatcgagtagttttccccgcctctctaaattggaaatctggaaatgcccagatctaacgtcatttccttcttgtccaagccttgaagagttggaattgaaagaaaacaatgaagcattgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaa

SEQ ID NO: 121 - protein, 488 aa, Spinacia oleracea
KWMCLRMLDLSWSDVKNLPNSIGKLLHLRCLNLSYNKDLLILPDAITRLHNLQTLLLKECRSLKELPKDFCKLVKLRHLDLRCSDLKELPKDFCKLVKLRHLDLWGCDDLIGVPLGMDRLISLRVLPFFVVGRKEQSDDDELKALKGLTEIKGSIRIRIYSKYRIVEGMNDTGGAGYLKSMKHLTGVDITFDGGCVNPEAVLATLEPPSNIKRLEMWHYSGTTIPVWGRAEINWAISLSHLVDIQLWHCRNLQEMPVLSKLPHLKSLELYNLISLEYMESTSRSSSSDTEAATPELPTFFPSLEKLTLWRLDKLKGFGNRRSSSFPRLSKLEIWKCPDLTSFPSCPSLEELELKENNEALQIIVKITTTRGKEEKEEDKNAGVGNSQDDDNVKLRKVEIDNVSYLKSLPTNCLTHLDLTIRDSKEGEGEWEVGDAFQKCVSSLRSLTIIGNHGINKVKRLSGRTGLEHFTLLESLKLSDIEDQEDEGE

SEQ ID NO: 122 - DNA, 1466 bp, Spinacia oleracea
acaagtggatgtgtcttaggatgttggacttgtcatggtcggatgttaaaaatttgcctaattcaataggtaaattgttgcacttgaggtgtcttaacctgtcttataataaagatctgttgatactccctgatgcaattacaagactgcataatttgcagacactgcttttaaaagagtgcagaagtttaaaggagttgccaaaagatttttgcaaattggtcaaactgaggcacttggatttaaggtgttctgatttgaaggagttgccaaaagatttttgcaaattggtcaaactgaggcacttggatttatggggttgtgatgatttgattggtgtgccattgggaatggataggctaattagtcttagagtactgccattctttgtggtgggtaggaaggaacaaagtgatgatgatgagctgaaagccctaaaaggcctcaccgagataaaaggctccattcgtattagaatctattcaaagtatagaatagttgaaggcatgaatgacacaggaggagctgggtatttaaagagcatgaaacatctcacgggggttgatattacatttgatggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttagactttggcgtctggacaagttgaagggttttgggaacaggagatcgagtagttttccccgcctctctaaattggaaatctggaaatgcccagatctaacgtcatttccttcttgtccaagccttgaagagttggaattgaaagaaaacaatgaagcattgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaa

SEQ ID NO: 123 - protein, 488 aa, Spinacia oleracea
KWMCLRMLDLSWSDVKNLPNSIGKLLHLRCLNLSYNKDLLILPDAITRLHNLQTLLLKECRSLKELPKDFCKLVKLRHLDLRCSDLKELPKDFCKLVKLRHLDLWGCDDLIGVPLGMDRLISLRVLPFFVVGRKEQSDDDELKALKGLTEIKGSIRIRIYSKYRIVEGMNDTGGAGYLKSMKHLTGVDITFDGGCVNPEAVLATLEPPSNIKRLEMWHYSGTTIPVWGRAEINWAISLSHLVDIQLWHCRNLQEMPVLSKLPHLKSLELYNLISLEYMESTSRSSSSDTEAATPELPTFFPSLEKLRLWRLDKLKGFGNRRSSSFPRLSKLEIWKCPDLTSFPSCPSLEELELKENNEALQIIVKITTTRGKEEKEEDKNAGVGNSQDDDNVKLRKVEIDNVSYLKSLPTNCLTHLDLTIRDSKEGEGEWEVGDAFQKCVSSLRSLTIIGNHGINKVKRLSGRTGLEHFTLLESLKLSDIEDQEDEGE

SEQ ID NO: 124 - DNA, 1397 bp, Spinacia oleracea
acaagtggatgtgtcttaggatgttggacttgtcaaggtcggatgttaaaaatttgcctaattcaataggtaaactattgcacttaaggtatcttaacctgtccggtaatagaaagttggagatactccctgatgcgattacaaaactgcataatttgcagacacttcttttagaaggttgcggaagtttaaaggagttgccaaaagatttttgcaaattggtcaaactgagacacttggatttatggggttgtgatgatttgattggtatgccattgggaatggatatgctaactagtcttagagtactgccatactttgtggtgggtaggaagaaacaaagtgttgatgatgagctgaaagccctaaaaggcctcaccgagataaaaggcgacattgatatcaaaatctgttccaattatagaatagttgaaggcatgaatgacacaggaggagctgggtatttgaagagcatgaaacatctcacgggggttgatattacatttgatggtggatgtgttaaccctgaagctgtgttggcaaccctagagccaccttcaaatatcaagagcttatctatagataattacgatggtacaacaattccagtatggggaagagcagagattaattgggcaatctccctctcacatcttgtcgacatttggttttgggattgtagtgatttgcaggagatgccagtgctgagtaaactgcctcatttgaaatcactggaactttttaagttttgtaagttagagtacatggagagtagaagcagcagcagtagcagtgacacagaagcagcaacaccagaattaccaacattcttcccttcccttgaaaaacttacactttggtatctggaaaagttgaagggtttggggaacaggagatcgagtagttttccccgcctctctgaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatctgggttatctcaaatcactgcccacaaattgtctgactcacctcgacattacaataagagattccaaggagggggagggtgaatgggaagttggggaggcatttcagaagtgtgtatcttctttgagaaagctcagcataatcggaaatcacggaataaataaagtgaagagactgtctggaagaacagggttggagcatttcactctgttggactcactcaaattttcagatatagacgaccaggaagatgagggcgaa

SEQ ID NO: 125 - protein, 465 aa, Spinacia oleracea
KWMCLRMLDLSRSDVKNLPNSIGKLLHLRYLNLSGNRKLEILPDAITKLHNLQTLLLEGCGSLKELPKDFCKLVKLRHLDLWGCDDLIGMPLGMDMLTSLRVLPYFVVGRKKQSVDDELKALKGLTEIKGDIDIKICSNYRIVEGMNDTGGAGYLKSMKHLTGVDITFDGGCVNPEAVLATLEPPSNIKSLSIDNYDGTTIPVWGRAEINWAISLSHLVDIWFWDCSDLQEMPVLSKLPHLKSLELFKFCKLEYMESRSSSSSSDTEAATPELPTFFPSLEKLTLWYLEKLKGLGNRRSSSFPRLSELEIWECPDLTWFPPCPSLKTLKLEKNNEALQIIVKITTTRGKEEKEEDKNAGVGNSQDDDNVKLRKVEIDNLGYLKSLPTNCLTHLDITIRDSKEGEGEWEVGEAFQKCVSSLRKLSIIGNHGINKVKRLSGRTGLEHFTLLDSLKFSDIDDQEDEGE

SEQ ID NO: 126 - DNA, 1526 bp, Spinacia oleracea
acaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttaaaagattgcagaagtttaaaggagttgccaaaagatttttgcaaattggtcaaactgagacacttggatttatggggttgtgatgatttgattggtatgccatttggaatggataagctaactagtcttagaatactaccaaacattgtggtgggtaggaaggaacaaagtgttgatgatgagctgaaagcccttaaaggcctcaccgagataaaaggcgacattgatatcaaaatctgtgaaaattatagaatagttgaaggcatgaatgacacaggaggagctgggtatttgaagagcatgaaacatctcagggagattggtattacatttgatggtggatgtgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggggtctggaaaagttgaagggtttggggaacaggagatcgagtagttttccccgcctctctgaattgaaaatcatggaatgcccagatctaacgtggtttcctccctgtccaagccttgaaaaacttacactttggcgtctggacaagttgaagggttttgggaaccggagatcgagtacttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcaaatcactgcccacaaattgtcttactcacctcgaccttacaataagtgattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaa

SEQ ID NO: 127 - protein, 508 aa, Spinacia oleracea
KWMCLRMLDLSWSDVKNLPNSIGKLLHLRYLNLSDNRNLKILPDAITRLHNLQTLLLKDCRSLKELPKDFCKLVKLRHLDLWGCDDLIGMPFGMDKLTSLRILPNIVVGRKEQSVDDELKALKGLTEIKGDIDIKICENYRIVEGMNDTGGAGYLKSMKHLREIGITFDGGCVNPEAVLATLEPPSNIKSLSIHRFDGKTLPVWGRAEINWAISLSHLVDIQLWHCRNLQEMPVLSKLPHLKSLELYNLISLEYMESTSRSSSSDTEAATPELPTFFPSLEKLTLWGLEKLKGLGNRRSSSFPRLSELKIMECPDLTWFPPCPSLEKLTLWRLDKLKGFGNRRSSTFPRLSELEIKKCPDLTSFPSCPSLEKLELKESNEALQIIVKITTRGKEKEENNNAGVRNSQDDDKVKLRKMVIDNLGYLKSLPTNCLTHLDLTISDSKEGEGEWEVGDAFQKCVSSLRSLTIIGNHGINKVKRLSGRTGLEHFTLLESLKLSDIEDQEDEGE

SEQ ID NO: 128 - DNA, 1406 bp, Spinacia oleracea
acaagtggatgtgtcttagggtgttggacttgtcaaggtcggatgttaaaaatttgcctaattcaataggtaaattgttgcacttgaggtgtcttaacctgtcttataataaagatctgttgatactccctgatgcaattacaagactgcataatttgcagacactgcttttaaaagattgcagaagtttaaaggagttgccaaaagatttttgcaaattggtcaaactgagacacttggatttaaggggttgtgatgatttgattggtatgccattgggaatggatatgctaactagtcttagagtactgccattctttgtggtgggtaggaaggaacaaagtgatgatgatgagctgaaagccctaaaaggcctcaccgagataaaaggcgacattgatatcaaaatctgttccaattatagaatagttgaaggcatgaatgacacaggaggagctgggtatttgaagagcatgaaacatctcacgggggttattattacatttgatgataatgaagatggatgtgttaaacctgaagctgtattggaaacccttgagccaccttcaaatatcaagaggttacttataggaaggtaccgtggtacaacaattccagtatggggaagagcagagattaattgggcaatctccctctcacatcttgtcgatatcacgcttatttattgttataatttgcaggagattccagtgctgagtaaactgcctcatttgaaattactggaactttataagttgattagcttagagtacatggagaatacaagcagaagcagtagcagtgacacagaagcagcaacactagaattaccaacattcttcccttcccttaaaaaacttacacttatcggtctgacaaagttgaagggtctggggaacaggagatcgagtagttttccccgcctctctaaattggtaatctgggaatgcccagatctaacgtggtttcctccttgtccaagccttgaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatctgggttatctcaaatcactgcccacaaattgtctgactcacctcgacattacaataagagattccgaaggggaggagggtgaatgggaagttggggatacatttcagaagtgtgtatcttctttgagaagcctcgtcataatcggaaatcagggaataaataaagtgaatagactgtctggaagaacagggttggagcatttcactctgttggactcactcaaattttcagatatagacgaccaggaagatgagggcgaa

SEQ ID NO: 129 - protein, 468 aa, Spinacia oleracea
KWMCLRVLDLSRSDVKNLPNSIGKLLHLRCLNLSYNKDLLILPDAITRLHNLQTLLLKDCRSLKELPKDFCKLVKLRHLDLRGCDDLIGMPLGMDMLTSLRVLPFFVVGRKEQSDDDELKALKGLTEIKGDIDIKICSNYRIVEGMNDTGGAGYLKSMKHLTGVIITFDDNEDGCVKPEAVLETLEPPSNIKRLLIGRYRGTTIPVWGRAEINWAISLSHLVDITLIYCYNLQEIPVLSKLPHLKLLELYKLISLEYMENTSRSSSSDTEAATLELPTFFPSLKKLTLIGLTKLKGLGNRRSSSFPRLSKLVIWECPDLTWFPPCPSLETLKLEKNNEALQIIVKITTTRGKEEKEEDKNAGVGNSQDDDNVKLWKVEIDNLGYLKSLPTNCLTHLDITIRDSEGEEGEWEVGDTFQKCVSSLRSLVIIGNQGINKVNRLSGRTGLEHFTLLDSLKFSDIDDQEDEGE

SEQ ID NO: 130 - DNA, 2078 bp, Spinacia oleracea
acaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttagaagattgcagaagtttaaaggagttgccaaaagatttttgcaaattggtcaaactgaggcacttggaattacagggttgtcatgatttgattggtatgccatttggaatggataagctaactagtcttagaatactaccaaacattgtggtgggtaggaaggaacaaagtgatgatgagctgaaagccctaaaaggcctcaccgagataaaaggctccatttctatcagaatctattcaaagtatagaatagttgaaggcatgaatgacacaggaggagctgcttatttgaagagcatgaaacatctcagggagattgatattacatttttgggtgaatgtgttggccctgaagctgtattggaaaccttagagccaccttcaaatatcaagagcttatatatatataattacagtggtacaacaattccagtatggggaagagcagagattaattgggcaatctccctctcacatctcgtcgacatccagcttagttgttgtagtaatttgcaggagatgccagtgctgagtaaactgcctcatttgaaatcgctgaaacttggatggttggataacttagagtacatggagagtagcagtagcagtgacacagaagcagcaacaccagaattaccaacattcttcccttcccttgaaaaacttactttacagcatctggaaaagttgaagggttttgggaacaggagatcgagtagttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttagactttggtatctggaaaagttgaagggtttggggaacaggagaccgagtagttttccccgcctctctgaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcaaattttcaaagatagaagaccaggaagatgagggcgaa

SEQ ID NO: 131 - protein, 692 aa, Spinacia oleracea
KWMCLRMLDLSWSDVKNLPNSIGKLLHLRYLNLSDNRNLKILPDAITRLHNLQTLLLEDCRSLKELPKDFCKLVKLRHLELQGCHDLIGMPFGMDKLTSLRILPNIVVGRKEQSDDELKALKGLTEIKGSISIRIYSKYRIVEGMNDTGGAAYLKSMKHLREIDITFLGECVGPEAVLETLEPPSNIKSLYIYNYSGTTIPVWGRAEINWAISLSHLVDIQLSCCSNLQEMPVLSKLPHLKSLKLGWLDNLEYMESSSSSDTEAATPELPTFFPSLEKLTLQHLEKLKGFGNRRSSSFPRLSELEIKKCPDLTSFPSCPSLEKLELKESNEALQIIVKITTRGKEKEENNNAGVRNSQDDDKVKLRKMVIDNLGYLTGVDIRFDDREGGFVNPEAVLATLEPPSNIKSLSIHRFDGKTLPVWGRAEINWAISLSHLVDIQLWHCRNLQEMPVLSKLPHLKSLELYNLISLEYMESTSRSSSSDTEAATPELPTFFPSLEKLRLWYLEKLKGLGNRRPSSFPRLSELEIWECPDLTWFPPCPSLKTLKLEKNNEALQIIVKITTTRGKEEKEEDKNAGVGNSQDDDNVKLRKVEIDNVSYLKSLPTNCLTHLKITGIDYREGEIESDSVEEEIELEVGEAFQKCASSLRSLIIIGNHGINKVMRLSGRTGLEHFTLLDSLKFSKIEDQEDEGE

SEQ ID NO: 132 - DNA, 1832 bp, Spinacia oleracea
acaagtggatgtgtcttaggatgttggacttgtcatggtcggatgttaaaaatttgcctaattcaataggtaaattgttgcacttgaggtgtcttaacctgtcttataataaagatctgttgatactccctgatgcaattacaagactgcataatttgcagacactgcttttaaaagagtgcagaagtttaaaggagttgccaaaagatttttgcaaattggtcaaactgaggcacttggatttaaggtgttctgatttgaaggagttgccaaaagatttttgcaaattggtcaaactgaggcacttggatttaaggtgttctgatttgaaggagttgccaaaagatttttgcaaattggtcaaactgaggcacttggatttatggggttgtgatgatttgattggtgtgccattgggaatggataggctaattagtcttagagtactgccattctttgtggtgggtaggaaggaacaaagtgatgatgatgagctgaaagccctaaaaggcctcaccgagataaaaggctccattcgtattagaatctattcaaagtatagaatagttgaaggcatgaatgacacaggaggagctgggtatttaaagagcatgaaacatctcacgggggttgatattacatttgatggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagctttggtgttgtagtaatttgcaggagatgccagtgctgagtaaactgcctcatttgaaatcactgtatctttttaagttttgtaagttagagtacatggagagtagaagcagcagcagtagcagtgacacagaagcagcaacaccagaattaccaacattcttcccttcccttgaaaaacttagactttggtatctggaaaagttgaagggtttggggaacaggagaccgagtagttttccccgcctctctgaattggaaatctgggaatgcccagatctaacgtggtttcctccctgtccaagccttgaaaaacttacactttggcgtctggacaagttgaagggtttggggaacaggagatcgagtagttttccccgcctctctaaattggtaatctggaaatgcccagatctaacgtggtttcctccctgtccaagccttgaaaaacttacactttggcgtctggacaagttgaagggtttggggaacaggagatcgagtagttttccccgcctctctgaattggaaatcaagaaatgcccagatctaacgtggtttcctccttgtccaagccttgaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattatggacggtggaaatagacaatctgggttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcaaactttcaaatatagaagaccaggaagatgagggcgaa

SEQ ID NO: 133 - protein, 610 aa, Spinacia oleracea
KWMCLRMLDLSWSDVKNLPNSIGKLLHLRCLNLSYNKDLLILPDAITRLHNLQTLLLKECRSLKELPKDFCKLVKLRHLDLRCSDLKELPKDFCKLVKLRHLDLRCSDLKELPKDFCKLVKLRHLDLWGCDDLIGVPLGMDRLISLRVLPFFVVGRKEQSDDDELKALKGLTEIKGSIRIRIYSKYRIVEGMNDTGGAGYLKSMKHLTGVDITFDGGCVNPEAVLATLEPPSNIKRLEMWHYSGTTIPVWGRAEINWAISLSHLVDIQLWCCSNLQEMPVLSKLPHLKSLYLFKFCKLEYMESRSSSSSSDTEAATPELPTFFPSLEKLRLWYLEKLKGLGNRRPSSFPRLSELEIWECPDLTWFPPCPSLEKLTLWRLDKLKGLGNRRSSSFPRLSKLVIWKCPDLTWFPPCPSLEKLTLWRLDKLKGLGNRRSSSFPRLSELEIKKCPDLTWFPPCPSLETLKLEKNNEALQIIVKITTTRGKEEKEEDKNAGVGNSQDDDNVKLWTVEIDNLGYLKSLPTNCLTHLKITGIDYREGEIESDSVEEEIELEVGEAFQKCASSLRSLIIIGNHGINKVMRLSGRTGLEHFTLLDSLKLSNIEDQEDEGE

SEQ ID NO: 134 - DNA, 1424 bp, Spinacia oleracea
acaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttagaagattgcagaagtttaaaggagttgccaaaagatttttgcaaattggtcaaactgagacacttggatttatggggttgtgatgatttgattggtatgccatttggaatggataagctaactagtcttagaatactaccaaacattgtggtgggtaggaaggaacaaagtgttgatgatgagctgaaagcccttaaaggcctcaccgagataaaaggcgacattgatatcaaaatctgtgaaaattatagaatagttgaaggcatgaatgacacaggaggagctgggtatttgaagagcatgaaacatctcagggagattggtattacatttgatggtggatgtgttaaccctgaagctgtgttggcaaccctagagccaccttcaaatatcaagagcttatctatagataattacgatggtacaacaattccagtatggggaagagcagagattaattgggcaatctccctctcacatcttgtcgacatcacgcttgaagattgttacaatttgcaggagatgccagtgctgagtaaactgcctcatttgaaatcactgtatctttttaagttttgtaagttagagtacatggagagtagaagcagcagcagtagcagtgacacagaagcagcaacaccagaattaccaacattcttcccttcccttgaaaaacttagactttggtatctggaaaagttgaagggtttggggaacaggagaccgagtagttttccccgcctctctgaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcaaattttcaaagatagaagaccaggaagatgagggcgaa

SEQ ID NO: 135 - protein, 474 aa, Spinacia oleracea
KWMCLRMLDLSWSDVKNLPNSIGKLLHLRYLNLSDNRNLKILPDAITRLHNLQTLLLEDCRSLKELPKDFCKLVKLRHLDLWGCDDLIGMPFGMDKLTSLRILPNIVVGRKEQSVDDELKALKGLTEIKGDIDIKICENYRIVEGMNDTGGAGYLKSMKHLREIGITFDGGCVNPEAVLATLEPPSNIKSLSIDNYDGTTIPVWGRAEINWAISLSHLVDITLEDCYNLQEMPVLSKLPHLKSLYLFKFCKLEYMESRSSSSSSDTEAATPELPTFFPSLEKLRLWYLEKLKGLGNRRPSSFPRLSELEIWECPDLTWFPPCPSLKTLKLEKNNEALQIIVKITTTRGKEEKEEDKNAGVGNSQDDDNVKLRKVEIDNVSYLKSLPTNCLTHLKITGIDYREGEIESDSVEEEIELEVGEAFQKCASSLRSLIIIGNHGINKVMRLSGRTGLEHFTLLDSLKFSKIEDQEDEGE

SEQ ID NO: 136 - DNA, 1516 bp, Spinacia oleracea
tcacgtgggttgtgttgtcgatagagatccagaaatagtctttttatgtagcaataagattcgttcgtatattagcggtcgttgtataaagaatccggtggattcacaaatagacaactggatgcgccttagggtgttggacttgtcagattcatgtgttaaagatttgtctgattcaataggtaagctgctgcacttaaggtatcttaacctctcttctaatataaagttggagataatccctgatgcaattacaagactgcataacttgcagacactgcttttaaaagattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaacttacagagttggataacttagagtacatggagagtagaagcagcagcagtagcagtgacacagaagcagcaacaccagaattaccaacattcttcccttcccttgaaaaacttacactttggggtctggaaaagttgaagggtttggggaacaggagatcgagtagttttccccgcctctctaaattggaaatctgggaatgcccagatctaacgtcatttccttcttgtccaagccttgaaaagttggaattgaaagaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatctgggttatctcaaatcactgcccacaaattgtctgactcacctcgaccttacaataagtgattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaa

SEQ ID NO: 137 - protein, 505 aa, Spinacia oleracea
HVGCVVDRDPEIVFLCSNKIRSYISGRCIKNPVDSQIDNWMRLRVLDLSDSCVKDLSDSIGKLLHLRYLNLSSNIKLEIIPDAITRLHNLQTLLLKDCRSLKELPKDFCKLVKLRHLDLRGCQCLIGMPLGMDRLISLRVLPKVVVGKKEQSDDQLKALKGLTEIKGSIDITIYSKYRIVEGMNDTGGAGYLKSMKHLTGVDIRFDDREGGFVNPEAVLATLEPPSNIKSLSIHRFDGKTLPVWGRAEINWAISLSHLVDIQLWHCRNLQEMPVLSKLPHLKSLELTELDNLEYMESRSSSSSSDTEAATPELPTFFPSLEKLTLWGLEKLKGLGNRRSSSFPRLSKLEIWECPDLTSFPSCPSLEKLELKENNEALQIIVKITTTRGKEEKEEDKNAGVGNSQDDDNVKLWKVEIDNLGYLKSLPTNCLTHLDLTISDSKEGEGEWEVGDAFQKCVSSLRSLTIIGNHGINKVKRLSGRTGLEHFTLLESLKLSDIEDQEDEGE

SEQ ID NO: 138 - DNA, 1424 bp, Spinacia oleracea
acaagtggatgtgtcttaggatgttggacttgtcaaggtcggatgttaaaaatttgcctaattcaataggtaaattgttgcacttgaggtatcttaacctgtcagataatagaaatctaaagatacttcctgatgcaattacaagactgcataatttgcagacactacttttagaacgttgcgaaagtttaaaggagttgccaaaagatttttgcaaattggtcaaactgagacacttggatttaaggggatgtttttctttgattggtatgccattgggaatggataggctaattagtcttagaatactaccaaacattgtggtgggtaggaaggaacaaagtgatgatgatgagctgaaagccctaaaaggcctcaccgagataaaaggctccattcgtattagaatctattcaaagtatagaatagttgaaggcatgaatgacacaggaggagctgggtatttaaagagcatgaaacatctcacgggggttgatattacatttgatggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggcgtctggacaagttgaagggttttgggaacaggagatcgagtagttttccccgcctctctaaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcgaactttcaaagatagaagaccaggaagatgagggcgaa

SEQ ID NO: 139 - protein, 474 aa, Spinacia oleracea
KWMCLRMLDLSRSDVKNLPNSIGKLLHLRYLNLSDNRNLKILPDAITRLHNLQTLLLERCESLKELPKDFCKLVKLRHLDLRGCFSLIGMPLGMDRLISLRILPNIVVGRKEQSDDDELKALKGLTEIKGSIRIRIYSKYRIVEGMNDTGGAGYLKSMKHLTGVDITFDGGCVNPEAVLATLEPPSNIKRLEMWHYSGTTIPVWGRAEINWAISLSHLVDIQLWHCRNLQEMPVLSKLPHLKSLELYNLISLEYMESTSRSSSSDTEAATPELPTFFPSLEKLTLWRLDKLKGFGNRRSSSFPRLSKLEIWECPDLTWFPPCPSLKTLKLEKNNEALQIIVKITTTRGKEEKEEDKNAGVGNSQDDDNVKLRKVEIDNVSYLKSLPTNCLTHLKITGIDYREGEIESDSVEEEIELEVGEAFQKCASSLRSLIIIGNHGINKVMRLSGRTGLEHFTLLDSLELSKIEDQEDEGE

SEQ ID NO: 140 - DNA, 30 bp, Spinacia oleracea
  Primer
gcagtcgaacatgtagctgactcaggtcac

SEQ ID NO: 141 - DNA, 30 bp, Spinacia oleracea
  Primer
tggatcacttgtgcaagcatcacatcgtag

SEQ ID NO: 142 - DNA, 50 bp, Spinacia oleracea
  Primer
gcagtcgaacatgtagctgactcaggtcacacaagtggatgtgtcttagg

SEQ ID NO: 143 - DNA, 49 bp, Spinacia oleracea
  Primer
tggatcacttgtgcaagcatcacatcgtagttcgccctcatcttcctgg

SEQ ID NO: 144 - DNA, 48 bp, Spinacia oleracea
gcagtcgaacatgtagctgactcaggtcactcacgtgggttgtgttgt

SEQ ID NO: 145 - DNA, 6583 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaggatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttaaaagattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattacatttttgggtgaatgtgttggccctgaagctgtattggaaaccttagagccaccttcaaatatcaagagcttatatatatataattacagtggtacaacaattccagtatggggaagagcagagattaattgggcaatctccctctcacatcttgtcgacatcaagcttggttgttgtcgtaatttgcaggagatgccagtgctgagtaaactgcctcatttgaaatcgctgaaacttggatggttggataacttagagtacatggagagtagcagtagcagtgacacagaagcagcaacaccagaattaccaacattcttcccttcccttgaaaaacttactttacagcatctggaaaagttgaagggttttgggaacaggagatcgagtagttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagtagaagcagcagcagtagcagtgacacagaagcagcaacaccagaattaccaacattcttcccttcccttgaaaaacttacactttggtatctggaaaagttgaagggttttgggaacaggagaccgagtagttttccccgcctctctaaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcaaactttcaaatatagaagaccaggaagatgagggcgaagacaacatcatattctggaaatcctttcctcaaaaccttcgcagtttgagaattaaagactctgacaaaatgacaagtttgcccatggggatgcagtacttaacctccctccaaaccctcgaactatcatattgtgatgaattgaattcccttccagaatggataagcagcttatcatctcttcaatacctgcgcatatactactgtccagccctgaaatcactaccagaagcaatgcggaacctcacctcccttcagacacttgggatatcggattgtccagacctagttaaaagatgcagaaaacccaacggcaaggactatcccaaaattcaacacatccccaaaattgtaagtcattgcagaaagtaatttattcatttatatttattttatgcttagaatgatatacaccgtcgtcctttggtttcaaatcttgaatttggtttttgttttctttctttgtttctttattcaacaccagcccatttatgattgattcattaaaaaaaggatggagttttatggatttgaagaagacaacgaattgagattcctggggttttctttttgttggggttggatttcatgtatatgttgctgattaaatacgagactgatgatgatgatgtgtttatgggttttaaatcagattaaatatatgggaaatgcaagttaatttgggatgcacataaggtgtttgctgaaatgtctatgagaaatgttgtttcttggacttagaatgatatacactgtcgtcctttggtttccaatcttacatttggtttgtgttttcttagtttgtttctttaatcaacaccaacccgttttttttaaactacctgcaactactaatttacgtttaccctgtatctcaggtactaaatgaatattggtgattttcagttactcaacactagcttgatcctgaacgcacccaaccttcaggttagaatccggcttactcatccttttgtccagttttcaagtaattgttttggcaggatcaattctctaattgttgtacaccgtatattgcaatttatagtgactacagttaatgaatgtttacaaaaaattagtcatgtaaaaacttcttctctgtccattacataaactctttttctctttctaacttatcatgttcatgtctaaacaattaaacatgctcacatcaatgttcatttaagctaacttacttctgtaagagagcgagctagttaaaaactcctttaactttctgttttatactcaggacatggattgatgcaagcatgaagaacttcgggaatttgctaaaactctaccaaagcgatgagagtttggactttatttcacttgaagtcagggactgtcaacaaagccacagtgtgcatgttggctgtttcacttggacgataaaaaggtttatttaattgttttcctaagtgtatttggcttacaagcttttacttttcacttgaaagggtttttcttgttttaagcttttcgaattagagttttcggttgaagtaagagtagtcgtattagtcttttacctaaggaagactcttttttgtaattttcagactatgcaattcaagttttcgagtgttttcttgcttgtgtgattgtgagttggtgaattcgtctttcatacattttgagattatcagaagctttatgctccaccggtagtctagtaccttttctgttactgtgcagggaagtaatctggtaccttctatatatatggaaaaacatacattatacattatgcaaaattcttacaggttagttacttcctggaacttcatttacacttagttttttttgttccattccctcggaatcaagtcattccctctgagaaatatgtaatgaacttctgtatgttgctgtttggttcctgttttaatcttcaattttcttgtatagttacagctgcatttacaatgaagtttaagcagacactctctttatatagtgcctctttctggagcaccgtagagctgtctgtggttgatcaccatctgctgccgagagattcagcaatcgcgtgtttgatcaggtaaaagtttttatgtcaatgtgtttttttttccgtttgatcaatttatgtctgtattcagattcttatcttcttacagtagcataacacattgtttctttcatttatgtaaactgtttcaagattacagagatgtatgcttcagtcgacattgatgataacttaagatggcattcctacaacagttgcaggcgcattctaactccggcaattctagttaggcaagaggagcattgccaatacctgccacctctgggatttactataccagggttgaagtttatggaagacaccagctatgcacaagccttcaaggggtcatcctacataacaagttgaaccaaccaattgcttgttggttcagtggtaattggagctgaatttggtagggatggcccgtgttcgatccccacaacaacaattgggaggggactggaacctatccacacagaactcgccctgaatccggattagccctaagggtgaacggggtgctaacaccaaaaaaaaaacataacaagttgaaccaaacatactttgtttgaattgaagatttagtgatttcatttgatcgattgagatgtcttattataagcgtatatgctcttggatttggccacttaggtgttgtttgacaattggacattaactcgcttttatattttcttttctcttaggaaaggtgatcctgagaatttatattggaacactttttttttctcactagctttaaaaaagtgttctgtgttacctgcaatt

SEQ ID NO: 146 - DNA, 2354 bp, Spinacia oleracea
gggtgttgttagttaggcttgaataatatagacttttaaaaaattaggctaatttgatttaaaaaattgttacatatctaagaaaattgatgttaaatttatcagtcactgtataaacaataaaagtcaatatgtatgtaaaagggttgttagataaattttttggctttttggtccacagtaagaggaactccaatgcttagttacaaggtggtgtagttaaatttgctacaaggttgtgtagttaaagagtaactccaatatattatagttaaatttaccacattaaatttctagctacaatatatttaagctataaagtttctcattggttgactataatacgttatagcaccttataatattttatttaatatacaattttatgtattttaccttttttacatttttttcgtgatctacctgctcatatgagccacactaatttggtagctgcttatacaattcttgtatcaacggttggctacttgttcaaatatttttatttttttacgagtaagtcattttatgatcattgaagttgctctaatattatcatggacctattaacgcatgaataattaactcggtaggaattagtttcaaaataaaattcccctcacaaaaaaaaaaaaaaaaaaaaatcagaaaaccaaccttctccagtttactgttgtctaaagccaaagagcatggaattttccagtaatcgcagaccccaaattctcttctccaatcgtccctgtcaatttcagcaattgaatcaatcgttgattttaggatttgccgccaaaaaaatgaaaaatccatgaattttagggttcaaatttgatccgtaattgggaaaattttcagcaattgatcttccaaatcattcatacttgtttccagactgcaaatgaaaggtgcgaactttatactgcattttgattttccattactgtaatttattaagatgaactgcattttgcaattgttttattcgactactcatctttaaatcaaattgctaaattgctagctaattttcttatcatattgccaaaaatttgttgcttaaatgattccatttctctaattatttttgttttattggtagataaataattaaggcaaatttgccaaaaaggaccttttataactcaaattttgcgagaaaggaccttatataattttttttgtgaaaacacaccttaaagttttttttttgcgagaaatgacctaaggaaagtttccggcattgactgagcttttccggccattaacttgcacgtgagcagcacgtgtggcttacgttggctaaagacactgattttcccgactcttgaattttcaaacttgattttatttcgattttttttttcaactttagttttaaagcttagaattttggaggaaaattgggtgtgattagcaaaataaagccacacgtgcttctcacgtgtaagtcaatagccaaaaaagctcagtcaatgccggaaatttacttttggttgtctttcgcaaaaagaaattatattaatgtgtgatttgacaaaaaaaaaattatataaggtcctttctcgcaaaaaattttacattaaggtgttttttgacaaaaaaagttatataaggtcctttctcgcaaaatttggattataaaaggtcctttttaacaaatttgccaataattaaatatcagccccattaattgaatattcaaaggaaatgtatggtccaaaaatggcgtttaatagtcaatgccgtgttttatggggtggtggagtactatatgactgtgtgtggacttggagaagactagagagtattgattatcaaaatatggaccctgaaaatgaaaatgaaaatgatgtttttacactttaaaatcgtcaaaaaacaaaaatcctccttagcaatagtatttacacgtgctatttgcacggacttcaatgcaatagtgtaaatttacggtcaaagttttcattctaaagcgtaaataactttcatgaatggaggacggtagtataagtataacgttatagcctacaattttcttatcatattcatataaatttgtttctaaaagttgttttacttggctaaaatacttttgttcttattggcagataaacatcagtacgtccattattggccaacttgctgagtccattattggccaacttgaacatatacctccaaacaataatcaataatgtcgattatgaagtttgtgaatgcaatttattatcactttcatttataaaatgactacttgattaacacatacaatattacctttctccaaacaccctttcaattctgcttaatcttgttttctcatcatctcttcatctttctgaaaacacaaccca

SEQ ID NO: 147 - DNA, 4146 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaggatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttaaaagattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattacatttttgggtgaatgtgttggccctgaagctgtattggaaaccttagagccaccttcaaatatcaagagcttatatatatataattacagtggtacaacaattccagtatggggaagagcagagattaattgggcaatctccctctcacatcttgtcgacatcaagcttggttgttgtcgtaatttgcaggagatgccagtgctgagtaaactgcctcatttgaaatcgctgaaacttggatggttggataacttagagtacatggagagtagcagtagcagtgacacagaagcagcaacaccagaattaccaacattcttcccttcccttgaaaaacttactttacagcatctggaaaagttgaagggttttgggaacaggagatcgagtagttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagtagaagcagcagcagtagcagtgacacagaagcagcaacaccagaattaccaacattcttcccttcccttgaaaaacttacactttggtatctggaaaagttgaagggttttgggaacaggagaccgagtagttttccccgcctctctaaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcaaactttcaaatatagaagaccaggaagatgagggcgaagacaacatcatattctggaaatcctttcctcaaaaccttcgcagtttgagaattaaagactctgacaaaatgacaagtttgcccatggggatgcagtacttaacctccctccaaaccctcgaactatcatattgtgatgaattgaattcccttccagaatggataagcagcttatcatctcttcaatacctgcgcatatactactgtccagccctgaaatcactaccagaagcaatgcggaacctcacctcccttcagacacttgggatatcggattgtccagacctagttaaaagatgcagaaaacccaacggcaaggactatcccaaaattcaacacatccccaaaattgtactaaatgaatattggtga

SEQ ID NO: 148 - DNA, 4179 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaggatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgttttagttattgtgcagtgtttcccaaggatcatgaaataaagaaggagatgttgattgaactttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttaaaagattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattacatttttgggtgaatgtgttggccctgaagctgtattggaaaccttagagccaccttcaaatatcaagagcttatatatatataattacagtggtacaacaattccagtatggggaagagcagagattaattgggcaatctccctctcacatcttgtcgacatcaagcttggttgttgtcgtaatttgcaggagatgccagtgctgagtaaactgcctcatttgaaatcgctgaaacttggatggttggataacttagagtacatggagagtagcagtagcagtgacacagaagcagcaacaccagaattaccaacattcttcccttcccttgaaaaacttactttacagcatctggaaaagttgaagggttttgggaacaggagatcgagtagttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagtagaagcagcagcagtagcagtgacacagaagcagcaacaccagaattaccaacattcttcccttcccttgaaaaacttacactttggtatctggaaaagttgaagggttttgggaacaggagaccgagtagttttccccgcctctctaaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcaaactttcaaatatagaagaccaggaagatgagggcgaagacaacatcatattctggaaatcctttcctcaaaaccttcgcagtttgagaattaaagactctgacaaaatgacaagtttgcccatggggatgcagtacttaacctccctccaaaccctcgaactatcatattgtgatgaattgaattcccttccagaatggataagcagcttatcatctcttcaatacctgcgcatatactactgtccagccctgaaatcactaccagaagcaatgcggaacctcacctcccttcagacacttgggatatcggattgtccagacctagttaaaagatgcagaaaacccaacggcaaggactatcccaaaattcaacacatccccaaaattttactcaacactagcttgatcctgaacgcacccaaccttcaggacatggattga

SEQ ID NO: 149 - protein, 1381 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRGRGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTTRSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIELWMAQGYVVPLDGGQSIEDAAEEHFVILLRRCFFQDVKKDKYGDVDSVKIHDLMHDVAQEVGREELCVVNDNTKNLGDKIRHVHRDVIRYAQRVSLCSHSHKIRSYIGGNCEKRCVDTLIDKWMCLRMLDLSWSDVKNLPNSIGKLLHLRYLNLSDNRNLKILPDAITRLHNLQTLLLKDCRSLKELPKDFCKLVKLRHLDLRGCQCLIGMPLGMDRLISLRVLPKVVVGKKEQSDDQLKALKGLTEIKGSIDITIYSKYRIVEGMNDTGGAGYLKSMKHLTGVDITFLGECVGPEAVLETLEPPSNIKSLYIYNYSGTTIPVWGRAEINWAISLSHLVDIKLGCCRNLQEMPVLSKLPHLKSLKLGWLDNLEYMESSSSSDTEAATPELPTFFPSLEKLTLQHLEKLKGFGNRRSSSFPRLSELEIKKCPDLTSFPSCPSLEKLELKESNEALQIIVKITTRGKEKEENNNAGVRNSQDDDKVKLRKMVIDNLGYLTGVDIRFDDREGGFVNPEAVLATLEPPSNIKSLSIHRFDGKTLPVWGRAEINWAISLSHLVDIQLWHCRNLQEMPVLSKLPHLKSLELYNLISLEYMESRSSSSSSDTEAATPELPTFFPSLEKLTLWYLEKLKGFGNRRPSSFPRLSKLEIWECPDLTWFPPCPSLKTLKLEKNNEALQIIVKITTTRGKEEKEEDKNAGVGNSQDDDNVKLRKVEIDNVSYLKSLPTNCLTHLKITGIDYREGEIESDSVEEEIELEVGEAFQKCASSLRSLIIIGNHGINKVMRLSGRTGLEHFTLLDSLKLSNIEDQEDEGEDNIIFWKSFPQNLRSLRIKDSDKMTSLPMGMQYLTSLQTLELSYCDELNSLPEWISSLSSLQYLRIYYCPALKSLPEAMRNLTSLQTLGISDCPDLVKRCRKPNGKDYPKIQHIPKIVLNEYW

SEQ ID NO: 150 - protein, 1392 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRGRGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTTRSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIELWMAQGYVVPLDGGQSIEDAAEEHFVILLRRCFFQDVKKDKYGDVDSVKIHDLMHDVAQEVGREELCVVNDNTKNLGDKIRHVHRDVIRYAQRVSLCSHSHKIRSYIGGNCEKRCVDTLIDKWMCLRMLDLSWSDVKNLPNSIGKLLHLRYLNLSDNRNLKILPDAITRLHNLQTLLLKDCRSLKELPKDFCKLVKLRHLDLRGCQCLIGMPLGMDRLISLRVLPKVVVGKKEQSDDQLKALKGLTEIKGSIDITIYSKYRIVEGMNDTGGAGYLKSMKHLTGVDITFLGECVGPEAVLETLEPPSNIKSLYIYNYSGTTIPVWGRAEINWAISLSHLVDIKLGCCRNLQEMPVLSKLPHLKSLKLGWLDNLEYMESSSSSDTEAATPELPTFFPSLEKLTLQHLEKLKGFGNRRSSSFPRLSELEIKKCPDLTSFPSCPSLEKLELKESNEALQIIVKITTRGKEKEENNNAGVRNSQDDDKVKLRKMVIDNLGYLTGVDIRFDDREGGFVNPEAVLATLEPPSNIKSLSIHRFDGKTLPVWGRAEINWAISLSHLVDIQLWHCRNLQEMPVLSKLPHLKSLELYNLISLEYMESRSSSSSSDTEAATPELPTFFPSLEKLTLWYLEKLKGFGNRRPSSFPRLSKLEIWECPDLTWFPPCPSLKTLKLEKNNEALQIIVKITTTRGKEEKEEDKNAGVGNSQDDDNVKLRKVEIDNVSYLKSLPTNCLTHLKITGIDYREGEIESDSVEEEIELEVGEAFQKCASSLRSLIIIGNHGINKVMRLSGRTGLEHFTLLDSLKLSNIEDQEDEGEDNIIFWKSFPQNLRSLRIKDSDKMTSLPMGMQYLTSLQTLELSYCDELNSLPEWISSLSSLQYLRIYYCPALKSLPEAMRNLTSLQTLGISDCPDLVKRCRKPNGKDYPKIQHIPKILLNTSLILNAPNLQDMD

SEQ ID NO: 151 - DNA, 2078 bp, Spinacia oleracea
acaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttaaaagattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattacatttttgggtgaatgtgttggccctgaagctgtattggaaaccttagagccaccttcaaatatcaagagcttatatatatataattacagtggtacaacaattccagtatggggaagagcagagattaattgggcaatctccctctcacatcttgtcgacatcaagcttggttgttgtcgtaatttgcaggagatgccagtgctgagtaaactgcctcatttgaaatcgctgaaacttggatggttggataacttagagtacatggagagtagcagtagcagtgacacagaagcagcaacaccagaattaccaacattcttcccttcccttgaaaaacttactttacagcatctggaaaagttgaagggttttgggaacaggagatcgagtagttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagtagaagcagcagcagtagcagtgacacagaagcagcaacaccagaattaccaacattcttcccttcccttgaaaaacttacactttggtatctggaaaagttgaagggttttgggaacaggagaccgagtagttttccccgcctctctaaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcaaactttcaaatatagaagaccaggaagatgagggcgaa

SEQ ID NO: 152 - protein, 692 aa, Spinacia oleracea
KWMCLRMLDLSWSDVKNLPNSIGKLLHLRYLNLSDNRNLKILPDAITRLHNLQTLLLKDCRSLKELPKDFCKLVKLRHLDLRGCQCLIGMPLGMDRLISLRVLPKVVVGKKEQSDDQLKALKGLTEIKGSIDITIYSKYRIVEGMNDTGGAGYLKSMKHLTGVDITFLGECVGPEAVLETLEPPSNIKSLYIYNYSGTTIPVWGRAEINWAISLSHLVDIKLGCCRNLQEMPVLSKLPHLKSLKLGWLDNLEYMESSSSSDTEAATPELPTFFPSLEKLTLQHLEKLKGFGNRRSSSFPRLSELEIKKCPDLTSFPSCPSLEKLELKESNEALQIIVKITTRGKEKEENNNAGVRNSQDDDKVKLRKMVIDNLGYLTGVDIRFDDREGGFVNPEAVLATLEPPSNIKSLSIHRFDGKTLPVWGRAEINWAISLSHLVDIQLWHCRNLQEMPVLSKLPHLKSLELYNLISLEYMESRSSSSSSDTEAATPELPTFFPSLEKLTLWYLEKLKGFGNRRPSSFPRLSKLEIWECPDLTWFPPCPSLKTLKLEKNNEALQIIVKITTTRGKEEKEEDKNAGVGNSQDDDNVKLRKVEIDNVSYLKSLPTNCLTHLKITGIDYREGEIESDSVEEEIELEVGEAFQKCASSLRSLIIIGNHGINKVMRLSGRTGLEHFTLLDSLKLSNIEDQEDEGE

SEQ ID NO: 153 - DNA, 2078 bp, Spinacia oleracea
acaagtggatgtgtcttaggatgttggacttgtcatggtcggatgttaaaaatttgcctaattcaataggtaaattgttgcacttgaggtgtcttaacctgtcttataataaagatctgttgatactccctgatgcaattacaagactgcataatttgcagacactgcttttaaaagagtgcagaagtttaaaggagttgccaaaagatttttgcaaattggtcaaactgagacacttggaattacagggttgtcatgatttgattggtatgccatttggaatggataagctaactagtcttagaatactaccaaacattgtggtgggtaggaaggaacaaagtgatgatgagctgaaagccctaaaaggcctcaccgagataaaaggctccatttctatcagaatctattcaaagtatagaatagttgaaggcatgaatgacacaggaggagctgcttatttgaagagcatgaaacatctcagggagattgatattacatttttgggtgaatgtgttggccctgaagctgtattggaaaccttagagccaccttcaaatatcaagagcttatatatatataattacagtggtacaacaattccagtatggggaagagcagagattaattgggcaatctccctctcacatctcgtcgacatccagcttagttgttgtagtaatttgcaggagatgccagtgctgagtaaactgcctcatttgaaatcgctgaaacttggatggttggataacttagagtacatggagagtagcagtagcagtgacacagaagcagcaacaccagaattaccaacattcttcccttcccttgaaaaacttactttacagcatctggaaaagttgaagggttttgggaacaggagatcgagtagttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatcaagcttagttgttgtcgtaatttgcaggagatgccagtgctgagtaaactgcctcatttgaaatcactggaacttcgatgtttggaaaacttagagtacatggagagtacaagcagaagcagtagcagtgacacagaagcagcaacaccagaattaccaacattcttcccttcccttgaaaaacttagactttggtatctggaaaagttgaagggtttggggaacaggagaccgagtagttttccccgcctctctgaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcaaactttcaaatatagaagaccaggaagatgagggcgaa

SEQ ID NO: 154 - protein, 692 aa, Spinacia oleracea
KWMCLRMLDLSWSDVKNLPNSIGKLLHLRCLNLSYNKDLLILPDAITRLHNLQTLLLKECRSLKELPKDFCKLVKLRHLELQGCHDLIGMPFGMDKLTSLRILPNIVVGRKEQSDDELKALKGLTEIKGSISIRIYSKYRIVEGMNDTGGAAYLKSMKHLREIDITFLGECVGPEAVLETLEPPSNIKSLYIYNYSGTTIPVWGRAEINWAISLSHLVDIQLSCCSNLQEMPVLSKLPHLKSLKLGWLDNLEYMESSSSSDTEAATPELPTFFPSLEKLTLQHLEKLKGFGNRRSSSFPRLSELEIKKCPDLTSFPSCPSLEKLELKESNEALQIIVKITTRGKEKEENNNAGVRNSQDDDKVKLRKMVIDNLGYLTGVDIRFDDREGGFVNPEAVLATLEPPSNIKSLSIHRFDGKTLPVWGRAEINWAISLSHLVDIKLSCCRNLQEMPVLSKLPHLKSLELRCLENLEYMESTSRSSSSDTEAATPELPTFFPSLEKLRLWYLEKLKGLGNRRPSSFPRLSELEIWECPDLTWFPPCPSLKTLKLEKNNEALQIIVKITTTRGKEEKEEDKNAGVGNSQDDDNVKLRKVEIDNVSYLKSLPTNCLTHLKITGIDYREGEIESDSVEEEIELEVGEAFQKCASSLRSLIIIGNHGINKVMRLSGRTGLEHFTLLDSLKLSNIEDQEDEGE

SEQ ID NO: 155 - DNA, 7138 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaggatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgcttcagttattgtgcagtgtttcccaaggatcatgaaataaagaaggagatgttgatttatctttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttaaaagattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattacatttttgggtgaatgtgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatcaagcttagttgttgtcgtaatttgcaggagatgccagtgctgagtaaactgcctcatttgaaatcactggaacttcgatgtttggaaaacttagagtacatggagagtagaagcagcagcagtagcagtgacaaagaagcagcaacaccagaattaccaacattcttcccttcccttgaaaaacttacactttggtatctggaaaagttgaagggtttggggaacaggagatcgagtagttttccccgcctctctaaattggaaatccgggaatgcccagatctaacgtggtttcctccttgtccaagccttgaaacgttgaaattggaaaaaaacaatgaagcgttgcaaaaaataacaacaacaagaggtaaagaagaaaaagaagaagacaagaatgctggtgttggaaattcacaagatgatgacaatgtcaaattacggaaggtgaaaatagacaatctgggttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggactcactcaaattttcaaagatagaagaccaggaagatgagggcgaagacaacatcatgttctggaaaacctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatccctgtacatatacaaatgtccagccctaaaatcactaccagaagcaatgcggaacctcacctcccttcagagccttgtgatacggcggtgtccagacctaattgaaagatgcgaagaacccaacggcgaggactatcccaaaattcgacacatctccagaattgtaagtcattgcagaaagtatttcttttttttctttttttattttatacttagaatgatatacaccgtcgtccttaggtttcaaatcttgaatttggtttttgttttctttctttgtttctttattcaacaccagtccatttatgattgattcattaaaaaaaggatggagttttatggatttgaagaagacaacgaattgagattcctggggttttttttttcgttggggttggttttcatgtatatgttgctgattaaatacgagactgatgatgatgatgtgtttatgggttttaaatcagattaaatatatgggaaatgcaagttaatttgggatgcacataaggtgtttgctgaaatgtctatgagaaatgttgtttcttggacttagaatgatatacactgtcgtcctttggtttccaatcttacatttggtttgtgttttcttagtttgtttctttaatcaacaccaacccgttttttttaaactacctgcaactactaatttacgtttaccctgtatctcaggtactaaatgaatattggtgattttcagttactcaacactagcttgatcctgaacgcacccaaccttcaggttagaatccggcttactcatccttttgtccagttttcaagtaattgttttggcaggatcaattctctaattgttgtacaccgtatattgcaatttatagtgactacagttaatgaatgtttacaaaaaattagtcatgtaaaaacttcttctctgtccattacataaactctttttctctttctaacttatcatgttcatgtctaaacaattaaacatgctcacatcaatgttcatttaagctaacttacttctgtaagagagcgagctagttaaaaactcctttaactttctgttttatactcaggacatggattgatgcaagcatgaagaacttcgggaatttgctaaaactctaccaaagcgatgagagtttggactttgtttcacttgaagtcagggactgtcaacaaagccacagtgtgcatgttggctgtttcacttggacgataaaaaggtttatttaattgttttcctaagtgtatttggcttacaagcttttacttttcgcttgaaagggtttttcttgttttaagctttttgaattagagtttcggttgaagtaagagtagtcgtattagtcttttactttgcaggagtctatgcctatataaggtaagactcgtatttgtaattttcagattatgcaattcaagttttcgagtgttttcttaaaaaaacatatcatacctgtgtgtagcataaagataaattctgatgctgtgcttctggttatggctcacattggttttcattgtttggattgtttcacagggaagcagagaatacctggaacctgtaaaggacgctatatctatagcagctttcacaggccaagtaatataatgttctttatcaatcactcaatacctggagattgtttgaacacataattcacctctttttttccatctcaaattgcagacttttactgggatttgaatgacagcaaacatttgattgtcacgaggattgatctaactggtgaatgttgtgatcaccatattggtctttctcattcaaacaaacttgcataccgttcttttgcagtttgaagacaagcaggcgataatcaactcaggtcgaagctcatgtgcaggagagaatagaatatagaggagattatttttaaaagaaacgctcaaaggtattgtagcacctttcctatttgctactgcagtgatgtttttatttcttgtttgcagcgcttgtttctcatatttcaacctacttttagaaaaaaaaacatctccgaacataaccaaaaataaagttcccttatcagtgctttctctgcttcttctaaacaacatatacaattataaaccctttttctctcttacctttgttattcttccttgcttcattgagataacactctcctgtttttgttttgttgttagtcattacatggatatatcaaggacaacagttctgtagtccgtcaactgtggttaggaaggctaaactggagcacaataaccccatgtcaattgaatagtaaaggtgtgctatatcagtttcgtttggcttggcttgtttacctgaaaaatggctggttatttatccttgtctctttctatgacgtgcagtggcttgttaatgtgtctcggacaacaattcctcactttccaagttccatacacgctgatgtaactatcttctgcagtctgttctttcatttttgccacgtgctctaattataactttttgtactcaataatcaactccttgtcccggtatttgcagagactacttaaacaggtaaagtgacaatcctggcgaagttgtctgtttcttagctctgaacccatcattcaggtaagattaagtatttaagaagaaattttgtttttacctaaaatgaatgatcttgtgtaactgcttgcttcttgcattaaataagaactttctgctgcatatgtgacagttacatccacaaaaaagttggaggtttgttcagggattggaaatgaaggtacttcagaattcctggaatgtttatgaatgctccagacttcagagtctttaatggaaaattcgagtcactaaaaatacattattcctatcatcagagctttcaagttcctctatacaaggtcaactgagttcctctttgcctcttgtttaattgtatttacttgtaccttaattataatctgtatattgttttagttaagttctaaaacaggttactattcatcatttgtgcagcatattgctggaatcaagaatctagtgcttcttcttcctgacttcactgtcaaaatagcagttcccatgctggaaataagcgcgctagcaatgtaattgatgacatggatgttgctgcttctgagttttgatcataaaaagctgttatgtgtttcttgaatgtaatgtagaagaggagaaaactgaaaactcttggcaaaaacgtgaaattgcagtgcctcggggtgggagggatcacccggattcagttcagacgatacttttttcaacccggtttgttccggttttcagcttcaggttttccttgtacttttgggggacacagacaaggctacttcatgtttgagaaacctaattgaggctatcttgtagcaaatgcacaccacactctttctctcttctctccttttttcaccttccatttgtaaaaatcctcctttaaaggttaataaaaaaaaagctccaagtctcgtagggtggatgtaggtcacattgaccgaaccacggtaaactctttgtgttctttcttctctctttgtttctcatttttacggcaagtgtttatggttaaccatgcatcttagaatagcttaaggcattaacataataacatcaatgttctccaaagattcaccttacttgttgtacataatcacaatgttaagcctatgaaggtagaatgctctcatgatttggtttaaccaaaaaataaactctaaaataatacggagtaataaaaattggccataaactaattacaaagtttgatttttgtatagggtatcttgtacttgtgataaaaaaaaattaaaaaaattaaaaaaataaataaattacttattccttctatttttacttgttacacttttctacaacagaaacatcaaaacgc

SEQ ID NO: 156 - DNA, 2304 bp, Spinacia oleracea
ggtgttgttagttaggcttgaataatatagacttttaaaaaattaggctaatttgatttaaaaaattgttacatatctaagaaaattgatgttaaatttatcagtcactgtataaacaataaaagtcaatatgtatgtaaaagggttgttagataaaatttttggctttttggtccacagtaagaggaactccaatgcttagttacaaggtggtgtagttaaatttgctacaaggttgtgtagttaaagagtaactccaatatattatagttaaatttaccacattaaatttctagctacaatatatttaagctataaagtttctcattgattgactataatacgttatagcaccttataatattttatttaatatacaattttatgtattttaccttttttacatttttttcgtgatctacctgctcatatgagccacactaatttggtagctgcttatacaattcttgtatcaacggttggttacttgttcaaatatttttatttttttacgagtaagtcattttatgatcattgaagttgctctaatattatcatggacctattaacgcatgaataattaactcggtaggaattagtttcaaaataaaattcccctcacaaaaaaaaaaaaaaaaaaaaaaatcagaaaaccaaccttctccagtttactgttgtctaaagccaaagagcatggaattttccagtaatcgcagaccccaaattctcttctccaatcgtccctgtcaatttcagcaattgaatcaatcgttgattttaggatttgccgccaaaaaaatgaaaaatccatgaattttagggttcaaatttgatccgtaattgggaaaattttcagcaattgatcttccaaatcattcatacttgtttccagactgcaaatgaaaggtgcgaactttatactgcattttgattttccattactgtaatttattaagatgaactgcattttgcaattgttttattcgactactcatctttaaatcaaattgctaaattgctagctaattttcttatcatattgccaaaaatttgttgcttaaatgattccatttctctaattatttttgttttattggtagataaataattaaggcaaatttgccaaaaaggaccttttataactcaaattttgcgagaaaggaccttatataattttttttgtgaaaacacaccttaaagttttttttttgcgagaaatgacctaaggaaagtttccggcattgactgagcttttccggccattaacttgcacgtgagcagcacgtgtggcttacgttggctaaagacactgattttcccgactcttgaattttcaaacttgattttatttcgattttttttttcaactttagttttaaagcttagaattttggaggaaaattgggtgtgattagcaaaataaagccacacgtgcttctcacgtgtaagtcaatagccaaaaaagctcagtcaatgccggaaatttacttttggttgtctttcgcaaaaagaaattatattaatgtgtgatttgacaaaaaaaaattatataaggtcctttctcgcaaaattttttacattaaggtgttttttgacaaaaaaagttatataaggtcctttctcgcaaaatttggattataaaaggtcctttttaacaaatttgccaataattaaatatcagccccattaattgaatattcaaaggaaatgtatggtccaaaaatggcgtttaatagtcaatgccgtgttttatggggtggtggagtactatatgactgtgtgtggacttggagaagactagagagtattgattatcaaaatatggaccctgaaaatgaaaatgaaaatgatgtttacacgtgctatttgcacggacttcaatgcaaatagtataaatttacggtcaaagttttcattctaaagcgtaaataactttcatgaatggaggacggtagtataagtataacgttatagcctaccattttcttatcatattcacataaatttgttgctgaaatttgttttacttggctaaaatacttttgttcttattggcagataaacatcagtacgtccattattggccaacttgctgagtccattattggccaacttgaacatatacctccaaacaataatcaataatgtcgattatgaagtttgtgaatgcaatttattatcactttcatttataaaatgactacttgattaacacatacaatattacctttctccaaacaccctttcaattctgcttaatcttgttttctcatcatctcttcatctttctgaaaacacaaccca

SEQ ID NO: 157 - DNA, 3453 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaggatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgcttcagttattgtgcagtgtttcccaaggatcatgaaataaagaaggagatgttgatttatctttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttaaaagattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattacatttttgggtgaatgtgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatcaagcttagttgttgtcgtaatttgcaggagatgccagtgctgagtaaactgcctcatttgaaatcactggaacttcgatgtttggaaaacttagagtacatggagagtagaagcagcagcagtagcagtgacaaagaagcagcaacaccagaattaccaacattcttcccttcccttgaaaaacttacactttggtatctggaaaagttgaagggtttggggaacaggagatcgagtagttttccccgcctctctaaattggaaatccgggaatgcccagatctaacgtggtttcctccttgtccaagccttgaaacgttgaaattggaaaaaaacaatgaagcgttgcaaaaaataacaacaacaagaggtaaagaagaaaaagaagaagacaagaatgctggtgttggaaattcacaagatgatgacaatgtcaaattacggaaggtgaaaatagacaatctgggttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggactcactcaaattttcaaagatagaagaccaggaagatgagggcgaagacaacatcatgttctggaaaacctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatccctgtacatatacaaatgtccagccctaaaatcactaccagaagcaatgcggaacctcacctcccttcagagccttgtgatacggcggtgtccagacctaattgaaagatgcgaagaacccaacggcgaggactatcccaaaattcgacacatctccagaattgtactaaatgaatattggtga

SEQ ID NO: 158 - DNA, 3486 bp, Spinacia oleracea
atggccgaaatcggatactcggtttgtgcgaaactcatcgaagtgattggcagtgagctgatcaaagagatttgtgacacatggggttacaaatctcttcttgaggacctcaacaaaactgtattgacggtcaggaacgttctcattcaagccggggtgatgcgggagcttactagtgaacaacaaggtttcattgcagaccttaaagatgttgtttatgatgctgatgacttgttcgacaagttactcactcgtgctgagcgaaaacagattgatggaaacgaaatctctgaaaaggtacgtcgtttcttttcctctagtaacaagatcggtcaagcttactacatgtctcgtaaggttaaggaaattaagaagcagttggatgaaattgttgataggcatacaaaatttgggtttagtgctgagtttatacctgtttgtaggggaaggggaaacgagagggaaacacgttcatatatagatgtcaagaatattcttgggagggataaagataagaatgatatcatagataggttgcttaatcgtaatggtaatgaagcttgtagtttcctgaccatagtgggagcgggaggattgggaaaaactgctcttgcacaacttgtgttcaatgatgaaagggtcaaaattgagttccatgatttgaggtattgggtttgtgtctctgatcaagatgggggccaatttgatgtgaaagaaatcctttgtaagattttagaggtggttactaaggagaaagttgataatagttccacattggaattggtacaaagccaatttcaagagaagttaagaggaaagaagtacttccttgttcttgatgatgtatggaacgaggatcgtgagaagtggcttcctttggaagagttgttaatgttgggtcaagggggaagcaaggttgtagtgaccacacgttcagagaagacagcaaatgtcatagggaaaagacatttttatacactggaatgtttgtcaccagattattcatggagcttatttgaaatgtcggcttttcagaaagggcatgagcaggaaaaccatcacgaactagttgatattgggaaaaagattgttgaaaaatgttataacaatccacttgctataacggtggtaggaagtcttctttatggagaggagataagtaagtggcggtcatttgaaatgagtgagttggccaaaattggcaatggggataataagattttgccgatattaaagctcagttaccataatcttataccctcgttgaagagttgcttcagttattgtgcagtgtttcccaaggatcatgaaataaagaaggagatgttgatttatctttggatggcacaaggatatgttgtgccgttggatggaggtcaaagtatagaagatgctgccgaggaacattttgtaattttgttacgaaggtgtttctttcaagatgtaaagaaggataaatatggtgatgttgattctgttaaaatccacgacttgatgcacgatgtcgcccaagaagtggggagggaggaattatgtgtagtgaatgataatacaaagaacttgggtgataaaatccgtcatgtacatcgtgatgtcattagatatgcacaaagagtctctctgtgtagccatagccataagattcgttcgtatattggtggtaattgtgaaaaacgttgtgtggatacactaatagacaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttaaaagattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattacatttttgggtgaatgtgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatcaagcttagttgttgtcgtaatttgcaggagatgccagtgctgagtaaactgcctcatttgaaatcactggaacttcgatgtttggaaaacttagagtacatggagagtagaagcagcagcagtagcagtgacaaagaagcagcaacaccagaattaccaacattcttcccttcccttgaaaaacttacactttggtatctggaaaagttgaagggtttggggaacaggagatcgagtagttttccccgcctctctaaattggaaatccgggaatgcccagatctaacgtggtttcctccttgtccaagccttgaaacgttgaaattggaaaaaaacaatgaagcgttgcaaaaaataacaacaacaagaggtaaagaagaaaaagaagaagacaagaatgctggtgttggaaattcacaagatgatgacaatgtcaaattacggaaggtgaaaatagacaatctgggttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggactcactcaaattttcaaagatagaagaccaggaagatgagggcgaagacaacatcatgttctggaaaacctttcctcaaaacctccgcagtttgagaattaaagactctgacaaaatgacaagtttgcccatggggatgcagtacttaacctccctccaaaccctctatctacaccattgttatgaattgaattcccttccagaatggataagcagcttatcatctcttcaatccctgtacatatacaaatgtccagccctaaaatcactaccagaagcaatgcggaacctcacctcccttcagagccttgtgatacggcggtgtccagacctaattgaaagatgcgaagaacccaacggcgaggactatcccaaaattcgacacatctccagaattttactcaacactagcttgatcctgaacgcacccaaccttcaggacatggattga

SEQ ID NO: 159 - protein, 1150 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRGRGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTTRSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIYLWMAQGYVVPLDGGQSIEDAAEEHFVILLRRCFFQDVKKDKYGDVDSVKIHDLMHDVAQEVGREELCVVNDNTKNLGDKIRHVHRDVIRYAQRVSLCSHSHKIRSYIGGNCEKRCVDTLIDKWMCLRMLDLSWSDVKNLPNSIGKLLHLRYLNLSDNRNLKILPDAITRLHNLQTLLLKDCRSLKELPKDFCKLVKLRHLDLRGCQCLIGMPLGMDRLISLRVLPKVVVGKKEQSDDQLKALKGLTEIKGSIDITIYSKYRIVEGMNDTGGAGYLKSMKHLTGVDITFLGECVNPEAVLATLEPPSNIKSLSIHRFDGKTLPVWGRAEINWAISLSHLVDIKLSCCRNLQEMPVLSKLPHLKSLELRCLENLEYMESRSSSSSSDKEAATPELPTFFPSLEKLTLWYLEKLKGLGNRRSSSFPRLSKLEIRECPDLTWFPPCPSLETLKLEKNNEALQKITTTRGKEEKEEDKNAGVGNSQDDDNVKLRKVKIDNLGYLKSLPTNCLTHLDLTIRDSKEGEGEWEVGDAFQKCVSSLRSLTIIGNHGINKVKRLSGRTGLEHFTLLDSLKFSKIEDQEDEGEDNIMFWKTFPQNLRSLRIKDSDKMTSLPMGMQYLTSLQTLYLHHCYELNSLPEWISSLSSLQSLYIYKCPALKSLPEAMRNLTSLQSLVIRRCPDLIERCEEPNGEDYPKIRHISRIVLNEYW

SEQ ID NO: 160 - protein, 1161 aa, Spinacia oleracea
MAEIGYSVCAKLIEVIGSELIKEICDTWGYKSLLEDLNKTVLTVRNVLIQAGVMRELTSEQQGFIADLKDVVYDADDLFDKLLTRAERKQIDGNEISEKVRRFFSSSNKIGQAYYMSRKVKEIKKQLDEIVDRHTKFGFSAEFIPVCRGRGNERETRSYIDVKNILGRDKDKNDIIDRLLNRNGNEACSFLTIVGAGGLGKTALAQLVFNDERVKIEFHDLRYWVCVSDQDGGQFDVKEILCKILEVVTKEKVDNSSTLELVQSQFQEKLRGKKYFLVLDDVWNEDREKWLPLEELLMLGQGGSKVVVTTRSEKTANVIGKRHFYTLECLSPDYSWSLFEMSAFQKGHEQENHHELVDIGKKIVEKCYNNPLAITVVGSLLYGEEISKWRSFEMSELAKIGNGDNKILPILKLSYHNLIPSLKSCFSYCAVFPKDHEIKKEMLIYLWMAQGYVVPLDGGQSIEDAAEEHFVILLRRCFFQDVKKDKYGDVDSVKIHDLMHDVAQEVGREELCVVNDNTKNLGDKIRHVHRDVIRYAQRVSLCSHSHKIRSYIGGNCEKRCVDTLIDKWMCLRMLDLSWSDVKNLPNSIGKLLHLRYLNLSDNRNLKILPDAITRLHNLQTLLLKDCRSLKELPKDFCKLVKLRHLDLRGCQCLIGMPLGMDRLISLRVLPKVVVGKKEQSDDQLKALKGLTEIKGSIDITIYSKYRIVEGMNDTGGAGYLKSMKHLTGVDITFLGECVNPEAVLATLEPPSNIKSLSIHRFDGKTLPVWGRAEINWAISLSHLVDIKLSCCRNLQEMPVLSKLPHLKSLELRCLENLEYMESRSSSSSSDKEAATPELPTFFPSLEKLTLWYLEKLKGLGNRRSSSFPRLSKLEIRECPDLTWFPPCPSLETLKLEKNNEALQKITTTRGKEEKEEDKNAGVGNSQDDDNVKLRKVKIDNLGYLKSLPTNCLTHLDLTIRDSKEGEGEWEVGDAFQKCVSSLRSLTIIGNHGINKVKRLSGRTGLEHFTLLDSLKFSKIEDQEDEGEDNIMFWKTFPQNLRSLRIKDSDKMTSLPMGMQYLTSLQTLYLHHCYELNSLPEWISSLSSLQSLYIYKCPALKSLPEAMRNLTSLQSLVIRRCPDLIERCEEPNGEDYPKIRHISRILLNTSLILNAPNLQDMD

SEQ ID NO: 161 - DNA, 1385 bp, Spinacia oleracea
acaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttaaaagattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattacatttttgggtgaatgtgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatcaagcttagttgttgtcgtaatttgcaggagatgccagtgctgagtaaactgcctcatttgaaatcactggaacttcgatgtttggaaaacttagagtacatggagagtagaagcagcagcagtagcagtgacaaagaagcagcaacaccagaattaccaacattcttcccttcccttgaaaaacttacactttggtatctggaaaagttgaagggtttggggaacaggagatcgagtagttttccccgcctctctaaattggaaatccgggaatgcccagatctaacgtggtttcctccttgtccaagccttgaaacgttgaaattggaaaaaaacaatgaagcgttgcaaaaaataacaacaacaagaggtaaagaagaaaaagaagaagacaagaatgctggtgttggaaattcacaagatgatgacaatgtcaaattacggaaggtgaaaatagacaatctgggttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggactcactcaaattttcaaagatagaagaccaggaagatgagggcgaa

SEQ ID NO: 162 - protein, 461 aa, Spinacia oleracea
KWMCLRMLDLSWSDVKNLPNSIGKLLHLRYLNLSDNRNLKILPDAITRLHNLQTLLLKDCRSLKELPKDFCKLVKLRHLDLRGCQCLIGMPLGMDRLISLRVLPKVVVGKKEQSDDQLKALKGLTEIKGSIDITIYSKYRIVEGMNDTGGAGYLKSMKHLTGVDITFLGECVNPEAVLATLEPPSNIKSLSIHRFDGKTLPVWGRAEINWAISLSHLVDIKLSCCRNLQEMPVLSKLPHLKSLELRCLENLEYMESRSSSSSSDKEAATPELPTFFPSLEKLTLWYLEKLKGLGNRRSSSFPRLSKLEIRECPDLTWFPPCPSLETLKLEKNNEALQKITTTRGKEEKEEDKNAGVGNSQDDDNVKLRKVKIDNLGYLKSLPTNCLTHLDLTIRDSKEGEGEWEVGDAFQKCVSSLRSLTIIGNHGINKVKRLSGRTGLEHFTLLDSLKFSKIEDQEDEGE

SEQ ID NO: 163 - DNA, 1385 bp, Spinacia oleracea
acaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttaaaagattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggagctgggtatttgaagagcatgaaacatctcacgggggttgatattacatttttgggtgaatgtgttggccctgaagctgtattggaaaccctagagccaccttcaaatatcaagagcttatctatacatcgttttgatggtaaaacacttccagtatggggaagagcagagattaattgggcaatctccctctcacatcttgtcgacatcaagcttagttgttgtcgtaatttgcaggagatgccagtgctgagtaaactgcctcatttgaaatcactggaacttcgatgtttggaaaacttagagtacatggagagtagaagcagcagcagtagcagtgacaaagaagcagcaacaccagaattaccaacattcttcccttcccttgaaaaacttacactttggtatctggaaaagttgaagggtttggggaacaggagatcgagtagttttccccgcctctctaaattggaaatccgggaatgcccagatctaacgtggtttcctccttgtccaagccttgaaacgttgaaattggaaaaaaacaatgaagcgttgcaaaaaataacaacaacaagaggtaaagaagaaaaagaagaagacaagaatgctggtgttggaaattcacaagatgatgacaatgtcaaattacggaaggtgaaaatagacaatctgggttatctcaaatcactgcccacaaattgtcttactcacctcgaccttacaataagagattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggactcactcaaattttcaaagatagaagaccaggaagatgagggcgaa

SEQ ID NO: 164 - protein, 461 aa, Spinacia oleracea
KWMCLRMLDLSWSDVKNLPNSIGKLLHLRYLNLSDNRNLKILPDAITRLHNLQTLLLKDCRSLKELPKDFCKLVKLRHLDLRGCQCLIGMPLGMDRLISLRVLPKVVVGKKEQSDDQLKALKGLTEIKGSIDITIYSKYRIVEGMNDTGGAGYLKSMKHLTGVDITFLGECVGPEAVLETLEPPSNIKSLSIHRFDGKTLPVWGRAEINWAISLSHLVDIKLSCCRNLQEMPVLSKLPHLKSLELRCLENLEYMESRSSSSSSDKEAATPELPTFFPSLEKLTLWYLEKLKGLGNRRSSSFPRLSKLEIRECPDLTWFPPCPSLETLKLEKNNEALQKITTTRGKEEKEEDKNAGVGNSQDDDNVKLRKVKIDNLGYLKSLPTNCLTHLDLTIRDSKEGEGEWEVGDAFQKCVSSLRSLTIIGNHGINKVKRLSGRTGLEHFTLLDSLKFSKIEDQEDEGE

SEQ ID NO: 165 - DNA, 1424 bp, Spinacia oleracea
acaagtggatgtgtcttaggatgttggacttgtcaaggtcggatgttaaaaatttgcctaattcaataggtaaattgttgcacttgaggtatcttaacctgtcagataatagaaatctaaagatacttcctgatgcaattacaagactgcataatttgcagacactacttttagaacgttgcgaaagtttaaaggagttgccaaaagatttttgcaaattggtcaaactgagacacttggatttaaggggatgtttttctttgattggtatgccattgggaatggataggctaattagtcttagaatactaccaaacattgtggtgggtaggaaggaacaaagtgatgatgatgagctgaaagccctaaaaggcctcaccgagataaaaggctccattcgtattagaatctattcaaagtatagaatagttgaaggcatgaatgacacaggaggagctgggtatttgaagagcatgaaacatctcagggagattggtattacatttgatggtggatgtgttaaccctgaagctgtgttggcaaccctagagccaccttcaaatatcaagaggttagagatgtggcattacagtggtacaacaattccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggcgtctggacaagttgaagggttttgggaacaggagatcgagtagttttccccgcctctctaaattggaaatctgggaatgcccagatctaacgtggtttcctccttgtccaagccttaaaacgttgaaattggaaaaaaacaatgaagcgttgcaaataatagtaaaaataacaacaacaagaggtaaagaagaaaaagaagaagacaagaatgctggtgttggaaattcacaagatgatgacaatgtcaaattacggaaggtggaaatagacaatgtgagttatctcaaatcactgcccacaaattgtcttactcacctcaaaataactggaatagattacagggagggggagattgaatcagattccgtggaggaggagattgaattggaagttggggaggcatttcagaagtgtgcatcttctttgagaagcctcatcataatcggaaatcacggaataaataaagtgatgagactgtctggaagaacagggttggagcatttcactctgttggactcactcgaactttcaaagatagaagaccaggaagatgagggcgaa

SEQ ID NO: 166 - protein, 474 aa, Spinacia oleracea
KWMCLRMLDLSRSDVKNLPNSIGKLLHLRYLNLSDNRNLKILPDAITRLHNLQTLLLERCESLKELPKDFCKLVKLRHLDLRGCFSLIGMPLGMDRLISLRILPNIVVGRKEQSDDDELKALKGLTEIKGSIRIRIYSKYRIVEGMNDTGGAGYLKSMKHLREIGITFDGGCVNPEAVLATLEPPSNIKRLEMWHYSGTTIPVWGRAEINWAISLSHLVDIQLWHCRNLQEMPVLSKLPHLKSLELYNLISLEYMESTSRSSSSDTEAATPELPTFFPSLEKLTLWRLDKLKGFGNRRSSSFPRLSKLEIWECPDLTWFPPCPSLKTLKLEKNNEALQIIVKITTTRGKEEKEEDKNAGVGNSQDDDNVKLRKVEIDNVSYLKSLPTNCLTHLKITGIDYREGEIESDSVEEEIELEVGEAFQKCASSLRSLIIIGNHGINKVMRLSGRTGLEHFTLLDSLELSKIEDQEDEGE

SEQ ID NO: 167 - DNA, 1481 bp, Spinacia oleracea
acaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttaaaagattgcagaagtttaaaggagttgccaaaagatttttgcaaattggtcaaactgagacacttggatttaaggggttgtcagtgtttgattggtatgccattgggaatggataggctaattagtcttagagtactaccaaaagttgtggtgggtaagaaggaacaaagtgatgatcagctgaaagccctaaaaggcctcaccgagataaaaggctccattgatatcacaatctattcaaagtatagaatagttgaaggcatgaatgacacaggaggaggagctgggtatttgaagagcatgaaacatctcacgggggttaatattacatttgatgaaggtggatgtgttaaccctgaagctgtgtatttgaagagcatgaaacatctcacgagggttattattatatttgattataaaggtggatgtgttaaccctgaagctgtgttggcaaccctagagccaccttcaaatatcaagaggttagaggtgtggcattacgatggtacaacaattccagtatggggaagagcagagattaattgggcaatctccctctcacatcttgtcgacatcaagcttagttgttgtcgtaatttgcaggagatgccagtgctgagtaaactgcctcatttgaaatcactggaacttcgatgtttggaaaacttagagtacatggagagtacaagcagaagcagtagcagtgacacagaagcagcaacaccagaattaccaacattcttcccttcccttgaaaaacttacactttggcgtctggacaagttgaagggttttgggaacaggagatcgagtagttttccccgcctctctgaattggaaatctggaaatgcccagatctaacgtggtttccttcttgtccaagccttgaagagttggaattgaaagaaaacaatgaagcgttgcaaataatagtaaaaataacaacaacaagaggtaaagaagaaaaagaagaagacaagaatgctggtgttggaaattcacaagatgatgacaatgtcaaattatggaaggtggaaatagacaatctgggttatctcaaatcactgcccacaaattgtctgactcacctcgaccttacaataagagattccaaggagggggagattgaattggaagttggggaggcatttcagaagtgtgtatcttctttgagaagcctcaccataatcggaaatcacggaataaataaagtgaagagactgtctggaagaacagggttggagcatttcactctgttggaatcactcaaattttcaaagatagaagaccaggaagatgagggcgaa

SEQ ID NO: 168 - protein, 493 aa, Spinacia oleracea
KWMCLRMLDLSWSDVKNLPNSIGKLLHLRYLNLSDNRNLKILPDAITRLHNLQTLLLKDCRSLKELPKDFCKLVKLRHLDLRGCQCLIGMPLGMDRLISLRVLPKVVVGKKEQSDDQLKALKGLTEIKGSIDITIYSKYRIVEGMNDTGGGAGYLKSMKHLTGVNITFDEGGCVNPEAVYLKSMKHLTRVIIIFDYKGGCVNPEAVLATLEPPSNIKRLEVWHYDGTTIPVWGRAEINWAISLSHLVDIKLSCCRNLQEMPVLSKLPHLKSLELRCLENLEYMESTSRSSSSDTEAATPELPTFFPSLEKLTLWRLDKLKGFGNRRSSSFPRLSELEIWKCPDLTWFPSCPSLEELELKENNEALQIIVKITTTRGKEEKEEDKNAGVGNSQDDDNVKLWKVEIDNLGYLKSLPTNCLTHLDLTIRDSKEGEIELEVGEAFQKCVSSLRSLTIIGNHGINKVKRLSGRTGLEHFTLLESLKFSKIEDQEDEGE

SEQ ID NO: 169 - DNA, 2180 bp, Spinacia oleracea
acaagtggatgtgtcttaggatgttggacttgtcatggtcggatgttaaaaatttgcctaattcaataggtaaattgttgcacttgaggtatcttaacctgtcagataatagaaatctaaagatacttcctgatgcaattacaagactgcataatttgcagacactgcttttagaagattgcagaagtttaaaggagttgccaaaagatttttgcaaattggtcaaactgaggcacttggaattacagggttgtcatgatttgattggtatgccatttggaatggataagctaactagtcttagaatactaccaaacattgtggtgggtaggaaggaacaaagtgatgatgagctgaaagccctaaaaggcctcaccgagataaaaggctccatttctatcagaatctattcaaagtatagaatagttgaaggcatgaatgacacaggaggagctgcttatttgaagagcatgaaacatctcagggagattgatattacatttttgggtgaatgtgttggccctgaagctgtattggaaaccttagagccaccttcaaatatcaagagcttatatatatataattacagtggtacaacaattccagtatggggaagagcagagattaattgggcaatctccctctcacatctcgtcgacatccagcttagttgttgtagtaatttgcaggagatgccagtgctgagtaaactgcctcatttgaaatcgctgaaacttggatggttggataacttagagtacatggagagtagcagtagcagtgacacagaagcagcaacaccagaattaccaacattcttcccttcccttgaaaaacttactttacagcatctggaaaagttgaagggttttgggaacaggagatcgagtagttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcacgggggttgatattagatttgatgatagagaaggtggatttgttaaccctgaagctgtgttggcaaccctagagccaccttcaaatatcaagagcttatctatacatcgttttgatggtaaaacacttccagtatggggaagagcagagattaattgggcaatctccctctcacatcttgtcgacatccagctttggcattgtcgtaatttgcaggagatgccagtgctgagtaaactgcctcatttgaaatcactggaactttataatttgattagtttagagtacatggagagcacaagcagaagcagtagcagtgacacagaagcagcaacaccagaattaccaacattcttcccttcccttgaaaaacttacactttggggtctggaaaagttgaagggtttggggaacaggagatcgagtagttttccccgcctctctgaattgaaaatcatggaatgcccagatctaacgtggtttcctccctgtccaagccttgaaaaacttacactttggcgtctggacaagttgaagggttttgggaaccggagatcgagtacttttccccgcctctctgaattggaaatcaagaaatgcccagatctaacgtcatttccttcttgtccaagccttgagaagttggaattgaaagaaagcaatgaagcattgcaaataatagtaaaaataacaacaagaggtaaagaaaaagaagagaacaataatgctggtgttagaaattcacaagatgatgacaaagtcaaattacggaagatggtgatagacaatctgggttatctcaaatcactgcccacaaattgtcttactcacctcgaccttacaataagtgattccaaggagggggagggtgaatgggaagttggggatgcatttcagaagtgtgtatcttctttgagaagcctcaccataatcggaaatcacggaataaataaagtgaagagactgtctggaagaacagggttggagcatttcactctgttggaatcactcaaactttcagatatagaagaccaggaagatgagggcgaa

SEQ ID NO: 170 - protein, 726 aa, Spinacia oleracea; identical to SEQ ID NO: 111

SEQ ID NO: 171 - protein, 9 aa, Spinacia oleracea
  Motif N-terminus
MAEIGYSVC

SEQ ID NO: 172 - protein, 6 aa, Spinacia oleracea
  Motif
KWMCLR

SEQ ID NO: 173 - protein, 8 aa, Spinacia oleracea
  Motif
HVGCVVDR

SEQ ID NO: 174 - protein, 8 aa, Spinacia oleracea
  Additional motif
EDQEDEGE

SEQ ID NO: 175 - protein, 8 aa, Spinacia oleracea
DDQEDEGE

What is claimed is:

1. A primer pair for amplifying the LRR domain or part thereof of a WOLF allele from the genome of a spinach plant, wherein the forward primer is a nucleic acid molecule comprising the sequence of SEQ ID NO: 1 or SEQ ID NO: 3, and the reverse primer is a nucleic acid molecule comprising the sequence of SEQ ID NO: 2.

2. A method for selecting a spinach plant or part thereof comprising an allele that encodes a CC-NBS-LRR protein, said CC-NBS-LRR protein comprising (a) an N-terminus MAEIGYSVC (SEQ ID NO: 171) motif and (b) a KWMCLR (SEQ ID NO: 172) motif or a HVGCVVDR (SEQ ID NO: 173) motif,
said method comprising detecting amplification products from amplifying DNA of the spinach plant or part thereof with a forward primer comprising the sequence of SEQ ID NO: 1 or SEQ ID NO: 3, and a reverse primer comprising the sequence of SEQ ID NO: 2.

3. A method for selecting a spinach plant or part thereof comprising an allele that encodes a CC-NBS-LRR protein, said CC-NBS-LRR protein comprising (a) an N-terminus MAEIGYSVC (SEQ ID NO: 171) motif and (b) a KWMCLR (SEQ ID NO: 172) motif or a HVGCVVDR (SEQ ID NO: 173) motif, said method comprising amplifying DNA of the spinach plant or part thereof with a forward primer comprising the sequence of SEQ ID NO: 1 or SEQ ID NO: 3, and a reverse primer comprising the sequence of SEQ ID NO: 2; and selecting the spinach plant or part thereof having an amplified product.

4. A method for producing a spinach seed comprising selecting a spinach plant or part thereof comprising an allele that encodes a CC-NBS-LRR protein, said CC-NBS-LRR protein comprising (a) an N-terminus MAEIGYSVC (SEQ ID NO: 171) motif and (b) a KWMCLR (SEQ ID NO: 172) motif or a HVGCVVDR (SEQ ID NO: 173) motif, said selecting comprising detecting amplification products from amplifying DNA of the spinach plant or part thereof with a forward primer comprising the sequence of SEQ ID NO: 1 or SEQ ID NO: 3, and a reverse primer comprising the sequence of SEQ ID NO: 2; and growing the spinach plant or part thereof to seed production.

5. The method of claim 4 further comprising collecting the seed.

6. A method for producing a spinach seed comprising selecting a spinach plant or part thereof comprising an allele that encodes a CC-NBS-LRR protein, said CC-NBS-LRR protein comprising (a) an N-terminus MAEIGYSVC (SEQ ID NO: 171) motif and (b) a KWMCLR (SEQ ID NO: 172) motif or a HVGCVVDR (SEQ ID NO: 173) motif, said selecting comprising amplifying DNA of the spinach plant or part thereof with a forward primer comprising the sequence of SEQ ID NO: 1 or SEQ ID NO: 3, and a reverse primer comprising the sequence of SEQ ID NO: 2, and selecting the spinach plant or part thereof having an amplified product; and growing the spinach plant or part thereof to seed production.

7. The method of claim 6 further comprising collecting the seed.

* * * * *